United States Patent
Sarkis et al.

(10) Patent No.: US 10,308,955 B2
(45) Date of Patent: Jun. 4, 2019

(54) TRANSIENT EXPRESSION VECTORS, PREPARATION AND USES THEREOF

(71) Applicant: NEWVECTYS, Paris (FR)

(72) Inventors: Chamsy Sarkis, Boulogne Billancourt (FR); Dorothee Altemir, Sambin (FR); Nicolas Grandchamp, Viroflay (FR); Stephanie Philippe, Malakoff (FR)

(73) Assignee: NEWVECTYS, Paris (FR)

( * ) Notice: Subject to any disclaimer, the term of this patent is extended or adjusted under 35 U.S.C. 154(b) by 147 days.

(21) Appl. No.: 14/352,902

(22) PCT Filed: Oct. 26, 2012

(86) PCT No.: PCT/EP2012/071216
§ 371 (c)(1),
(2) Date: Apr. 18, 2014

(87) PCT Pub. No.: WO2013/060819
PCT Pub. Date: May 2, 2013

(65) Prior Publication Data
US 2014/0286907 A1    Sep. 25, 2014

Related U.S. Application Data

(60) Provisional application No. 61/551,620, filed on Oct. 26, 2011.

(30) Foreign Application Priority Data

Oct. 26, 2011 (EP) .................................... 11306384

(51) Int. Cl.
*C12N 15/86* (2006.01)
(52) U.S. Cl.
CPC .... *C12N 15/86* (2013.01); *C12N 2740/13043* (2013.01); *C12N 2740/15043* (2013.01); *C12N 2740/16043* (2013.01)
(58) Field of Classification Search
CPC .................................................... C12N 15/86
See application file for complete search history.

(56) References Cited

FOREIGN PATENT DOCUMENTS

| WO | WO 2005/116225 |   | 12/2005 |          |
|----|----------------|---|---------|----------|
| WO | WO 2005/116225 A1 | * | 12/2005 | ............ C12N 15/87 |
| WO | WO 2006/133184 A2 | * | 12/2006 |          |

OTHER PUBLICATIONS

Sharma et al. (2005, Antiviral Chemistry and Chemotherapy, vol. 16, pp. 169-182).*
Makinson et al. (2006, AIDS, vol. 20, pp. 1327-1336).*
Julias et al. (2001, J. Virology, vol. 75(14), pp. 6537-6546).*
Isel et al. (2010, Viruses, Jan. 2(1), pp. 213-243) (Year: 2010).*
Klaver et al. (1994, J. Virology, vol. 68(6), pp. 3830-3840) (Year: 1994).*
Beerens et al. (2001, JBC, vol. 276(33), pp. 31247-31256) (Year: 2001).*
Julias, J. G. et al. "Replication of Phenotypically Mixed Human Immunodeficiency Virus Type 1 Virions Containing Catalytically Active and Catalytically Inactive Reverse Transcriptase" *Journal of Virology*, Jul. 2001, pp. 6537-6546, vol. 75, No. 14.
Sharma, P. L. et al. "Retrovirus reverse transcriptases containing a modified YXDD motif" *Antiviral Chemistry & Chemotherapy*, 2005, pp. 169-182, vol. 16, No. 3.
Written Opinion in International Application No. PCT/EP2012/071216, dated May 31, 2013, pp. 1-5.
Li, X. et al. "Effects of Alterations of Primer-Binding Site Sequences on Human Immunodeficiency Virus Type 1 Replication" *Journal of Virology*, Oct. 1994, pp. 6198-6206, vol. 68, No. 10.

* cited by examiner

*Primary Examiner* — Thaian N Ton
*Assistant Examiner* — David A. Montanari
(74) *Attorney, Agent, or Firm* — Saliwanchik, Lloyd & Eisenschenk

(57) ABSTRACT

The present invention describes a recombinant retroviral vector which cannot by itself achieve complete reverse transcription as well as its uses, in particular for transiently transferring in vitro, ex vivo or in vivo at least one ribonucleic acid sequence of interest in a cell. Such a transient transgene expression is of interest in the context of research, therapy and more generally in the field of biotechnology.

14 Claims, 23 Drawing Sheets

Figure 1:
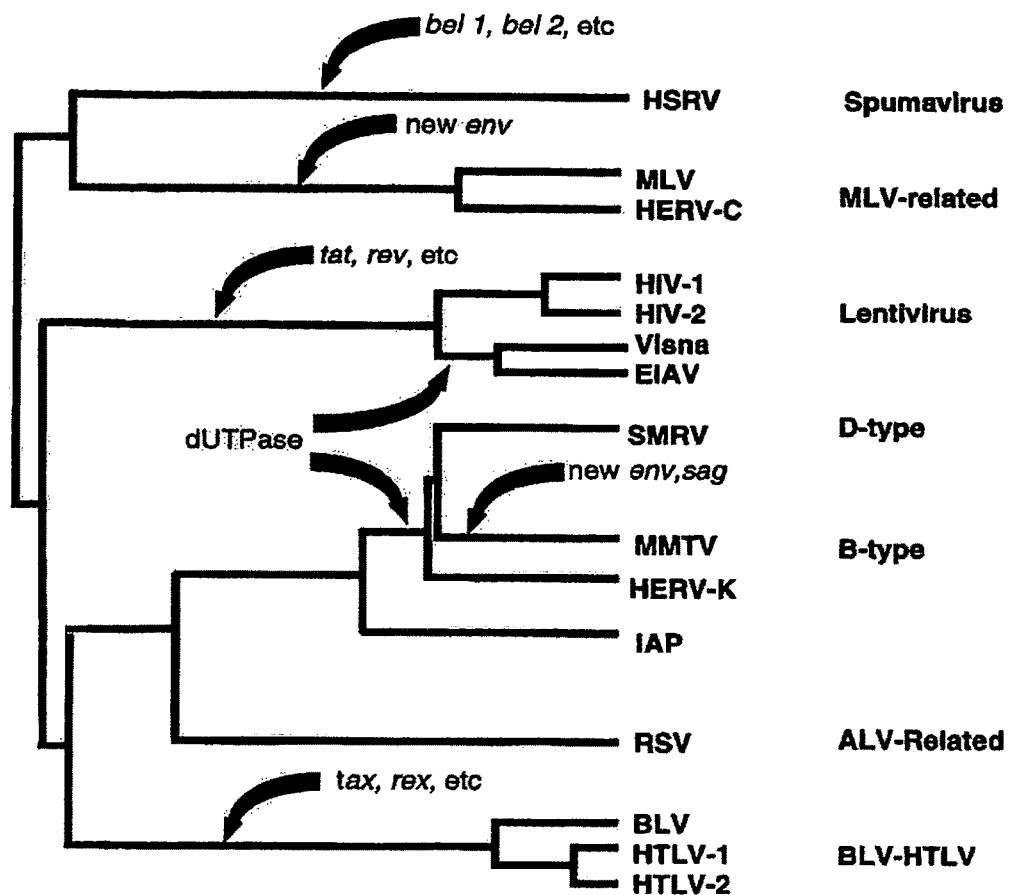

Specification includes a Sequence Listing.

I

II

TRANSIENT EXPRESSION VECTORS, PREPARATION AND USES THEREOF

CROSS-REFERENCE TO RELATED APPLICATIONS

This application is the U.S. national stage application of International Patent Application No. PCT/EP2012/071216, filed Oct. 26, 2012, which claims the benefit of U.S. Provisional Patent Application No. 61/551,620, filed Oct. 26, 2011.

The Sequence Listing for this application is labeled "Seq-List.txt" which was created on Apr. 18, 2014 and is 835 KB. The entire contents of the sequence listing is incorporated herein by reference in its entirety.

The present invention describes a recombinant retroviral vector which cannot by itself achieve complete reverse transcription as well as its uses, in particular for transiently transferring in vitro, ex vivo or in vivo at least one ribonucleic acid sequence of interest in a cell. Such a transient transgene expression is of interest in the context of research, therapy and more generally in the field of biotechnology.

BACKGROUND

As stated by R. Scott McIvor (Molecular Therapy, May 2011, 19(5):822-3, Therapeutic Delivery of mRNA: The Medium Is the Message), it seems as though every advance in gene transfer and expression needs to somehow provide a solution to the problem of genotoxicity. This relies on developing an alternative to gene transfer methods involving a DNA intermediate, which necessarily present a potential risk of insertional mutagenesis, no matter whether they are intended to be integrative or not. For instance WO 2005/116225 describes retroviral vectors producing DNA, the aim of these vectors being to avoid DNA integration into the host genome. However, due to the production of DNA, the risk of detrimental insertional mutagenesis persists due for example to host cell dependent recombination mechanisms. The present invention relates to a transient vector involving no DNA intermediate.

Messenger RNA (mRNA) has several advantages over DNA for gene transfer and expression, including the lack of any requirement for nuclear localization or transcription and the nearly negligible possibility of genomic integration of the delivered sequence.

However, the development of mRNA as therapeutic faces the same challenge as any nucleic acid: delivery. It is therefore likely that substantial improvements will be required in the efficiency of mRNA delivery and translation into protein product to reach a level that is of more general therapeutic utility.

The present invention now advantageously addresses these drawbacks and provides a new solution for the use of mRNA as a source of gene product usable in vitro, ex vivo or in vivo for both therapeutic or non-therapeutic (for example, research and transgenesis) applications. The present invention more widely answers the long-felt need for safe, efficient and transient gene transfer tools as further developed below.

Transiently transferring a nucleic acid or a protein, also herein respectively identified as "recombinant nucleic acid" or "transgene" and "recombinant protein", into a target cell is a major issue in the biotechnological field, in particular in a therapeutic or experimental context.

In the context of therapy, such a transient expression may be mandatory, for instance, for safety reasons, i.e., in order to avoid deleterious effects of a sustained expression of the recombinant protein in the subject exposed to this therapy or to prevent permanent integration of the recombinant nucleic acid into the host genome by preventing the generation of DNA intermediate forms of the recombinant nucleic acid.

In the context of non-therapeutic uses, the transient expression may be required, for example, in order to avoid deleterious effects such as positional effects or genomic toxicity. For example, in the context of transgenesis, the transient expression of a DNA-modifying enzyme may be advantageous in the zygote or early in the development of the organism to specifically modify a target locus. In this context, avoiding DNA intermediate forms encoding the DNA-modifying enzyme in the organism would advantageously prevent potential integration of the genome encoding the DNA-modifying enzyme, consequently preventing constitutive expression of said DNA modifying enzyme in said organism.

One may further wish to limit in vitro, ex vivo or in vivo the expression of a recombinant peptide, for example when such expression is only transiently required at a particular moment of a biological process.

Among the technical options currently available to allow the transient delivery of a nucleic acid or a peptide, the skilled person may select either a non-viral or a viral delivery method. The non-viral delivery method may be a direct peptide delivery method or a direct nucleotide delivery method. The viral delivery method may imply the use of replicative RNA viruses, such as RNA (±) viruses and RNA (−) viruses, or transpackaging of fusion proteins in non-replicative retroviral vectors.

Non-Viral Delivery Methods

Direct delivery of protein is chosen in specific contexts, such as for the delivery of a ligand of a cell membrane receptor in vitro or ex vivo. However, in most cases, if the action of the delivered factor is to be intracellular, the efficiency of direct delivery of protein in the culture media may be limiting and other methods should be considered. In addition, direct protein delivery does not allow for targeting a specific cell type, which is a particular issue for in vivo applications.

According to another method used in the art, nucleotide sequences (DNA and/or RNA) can be directly delivered to cells by mean of current transfection protocols based on chemical or physical methods, for in vitro, ex vivo or in vivo uses.

The cationic polymers (e.g., diethylaminoethyl (DEAE)-dextran, poly(l-lysine), dendrimers, polyethylenimine (PEI)) and the lipid vectors (e.g., liposomes or lipoplexes such as 1,2-dioleoyl-3-trimethylammonium-propane (DOTAP)) are examples of chemical compounds used to transfer nucleic acids.

Physical methods can also be considered for the transient delivery of nucleic acids into a target cell, such as electroporation. For DNA transfer, the strength of the electric shock required is high enough to allow the material to reach the cell nucleus. Such a shock may however be responsible for cell damage.

One can also consider delivering nucleic acid molecules by direct micro-injection into the target cells. This method is mainly applied for transgenesis purposes. It can also be used for gene transfer into poorly permissive cells. Micro-injection is limited to in vitro applications and it is a tedious method, highly time-consuming (cell by cell), and has not been automated so far for most cells.

These non-viral methods can be of interest under certain circumstances such as transient gene transfer into cell lines in vitro or, for example, in the muscle in vivo. However, they are in most cases of limited efficiency, do not allow targeting of a specific cell type and are not easily implemented since they require large amounts of highly purified recombinant nucleic acid and some of the recombinant nucleic acid based compositions, complexed with lipid compounds for instance, are particularly unstable and cannot be stored. In addition, in the case of plasmid DNA, bacterial sequences are retained that can have deleterious effects.

Viral Delivery Methods of RNA

Viruses are nucleoprotein particles transferring their nucleic information into a target cell and hijacking it for their own replication. For years, they have been modified to be used for gene transfer purposes in vitro, ex vivo and in vivo. "Viral vectors", also herein identified as "virus-derived vectors" or "vector particles", are mostly deprived of virulence factors and non-replicative. They further allow the expression of a sequence of interest: the transgene. They often overcome the lack of efficiency of non-viral gene transfer methods, taking advantage of the strategies viruses have developed over their evolution.

Viruses can be classified in several families, depending on the nature of their nucleic acid content and how it is processed during the viral cycle: RNA viruses contain RNA molecules ((+), (−) or double-stranded), DNA viruses contain DNA molecules (single- or double-stranded) and reverse transcribing viruses have their genome as RNA or DNA depending on the step of the replication cycle.

Among RNA viruses, RNA (+) viruses can be used for transient transfer of RNA because they are never present in the cell as a DNA molecule, i.e., they do not have DNA intermediates, thus precluding in theory any persistence of the viral information and subsequent mutagenic risk. Their genome is processed in the cell cytoplasm like a messenger RNA and is translated by cellular ribosomes for the production of viral proteins. One can thus modify them to carry only the information of interest. Viral vectors have been developed from several RNA (+) viruses including alphavirus (e.g., Sindbis, Semliki forest virus, Venezuelan equine encephalitis), picornavirus (e.g., poliovirus), or flavivirus (e.g., Kunjin virus).

Among those kinds of RNA (+) virus derived vectors, alphaviruses are preferred because of their ability to transduce a large quantity of exogenous proteins into cells of a large range of species. However they exhibit cytopathic effects precluding their use for most therapeutic purposes.

The RNA (−) viruses group comprises most of the main human pathogens, including flu, rabies and measles viruses. The RNA (−) genome is not infectious on its own but has to be associated with a RNA-dependent RNA-polymerase, which will generate the (+) strand.

While several viruses of this family have been used to develop RNA vectors, including measles, the most used one is the Sendai virus (SeV), a paramyxoviridae. The Sendai virus is not genotoxic and can replicate in a large range of mammalian tissues. It is the causative agent of respiratory infections in mice, guinea pigs, hamsters, rats and in rare cases in pigs, but is not pathogenic for humans. Sendai-derived vectors are used in a few therapeutic strategies, for instance in cystic fibrosis mouse models.

Nevertheless, one of the major drawbacks of these vectors derived from RNA (+) and RNA (−) viruses is the replication of the RNA genome and the formation of non-transmissible virus-like particles (NTVLP) into the host cell, leading to toxicity and cell death in many cases.

Viral Delivery Methods of Protein (Trans-Packaging of Fusion Proteins with HIV-1 Derived Particles)

An approach to transiently bring a protein into a target cell consists of the trans-packaging of a protein of interest in vector particles derived from HIV-1. This trans-packaging can be achieved by fusion with naturally encapsidated proteins.

Among the viral proteins investigated as trans-packaging partner is VPR (Viral Protein R), which has various functions in the HIV-1 cycle and pathogenicity. The fusion of a heterologous protein of interest to VPR allows one to encapsidate this protein. Such a strategy has for instance been tested for trans-complementation assays to study the functions of integrase and reverse transcriptase during the retroviral cycle. It can also be used to vectorise therapeutic proteins.

The main drawback of this VPR trans-packaging lies in the primary functions of VPR itself regarding cell cycle arrest and its pro-apoptotic and cytotoxic effects, all properties which originally drove the removal of VPR from the improved generation of HIV-1 vectors and which are retained in the fusion proteins. Another disadvantage is the relatively poor efficiency of trans-packaging, depending on the nature of the fusion protein.

Integrase is another viral protein that has been recently used, with mitigated successes, for trans-packaging of heterologous proteins in HIV-derived particles, to visualize cell/particle interactions (fusion with reporter genes), to develop targeted integration vectors (fusions with specific DNA-binding domains such as LexA or ZFN), and to vectorise proteins of interest (fusion with p53).

Based on fusion with either VPR or integrase (IN) or any other viral protein, the efficiency of trans-packaging strategy is limited by important factors: the low number of proteins that can be delivered and the functionality of the fused protein. Indeed, although the number of encapsidated VPR proteins is high in regard to the particle, the packaging efficiency of a fusion protein is expected to be lower, due to the limited size of the particle; this is also true for IN fusion proteins. This low delivery efficiency can, in particular cases, preclude the use of this method. In addition, a protein which is fused to VPR or IN may lose its function. In consequence, fusion is to be designed with caution in a way not to alter the protein of interest.

The present invention now offers a solution to the problems of the art and provides new tools and vectors for transiently expressing a transgene in vitro, ex vivo or in vivo with optimal safety.

BRIEF DESCRIPTION OF THE INVENTION

The inventors now herein provide new types of RNA vector derived from retroviruses, in particular RNA vectors as defined in the claims. These vectors are unable to achieve reverse transcription of their genome typically through the alteration of the reverse transcriptase enzyme present in the vector particles or as a consequence of the absence of said reverse transcriptase.

In particular, the present invention allows a transgene of interest to be transiently delivered in a specific target cell through the envelope-receptor interaction typical of the retroviral particles, without the formation of DNA intermediates that could induce persistent transgene expression or detrimental insertional mutagenesis risk. These DNA intermediate molecules were previously considered by skilled persons as an obligatory step for vectors derived from retroviruses to express a transgene.

Inventors herein demonstrate that such vectors, preferably vectors containing a mutated reverse transcriptase (RT) or no reverse transcriptase, allow transfer of the vector RNA genome into a host target cell, to transiently express a recombinant protein of interest for various purposes such as therapeutic applications or biotechnological applications. Said transgene expression exclusively results from direct translation of the retroviral RNA genome encapsidated into the particle of the invention and does not involve any DNA intermediate formation through reverse transcription in the target cell. This was totally unexpected until now, the skilled person considering the reverse transcription as a mandatory step in the process of transgene expression when using retroviral vectors (see Julias et al.: "Replication of phenotypically mixed human immunodeficiency virus type 1 virions containing catalytically active and catalytically inactive reverse transcriptase.", Journal of Virology, Vol. 75, no. 14, July 2001, pages 6537-6546).

Transient vectors were previously described based on retroviral vectors in dividing cells; however, they involved formation of DNA intermediates. The double-stranded DNA molecule was prevented from integrating, for instance due to mutation of the integrase protein. Retroviral vectors of the invention provide transient transgene expression without involving double-stranded DNA intermediate.

The invention is concerned particularly with a recombinant retroviral (-derived) vector which cannot on its own achieve complete reverse transcription, wherein the vector comprises a recombinant ribonucleic vector genome comprising a 5' LTR retroviral sequence and a 3' LTR retroviral sequence, flanking a retroviral psi encapsidation sequence and at least one transgene. Preferably, the recombinant retroviral vector genome is devoid of the gag, pol and/or env gene, for example the gag and pol genes, the gag and env genes or the pol and env genes, even more preferably the gag, pol and env genes. At least one of the gag, pol and env genes, as well as any fragments thereof, can intentionally be reintroduced into the vector genome as a "transgene", for example in the context of vaccination. Typically, the gag gene may be reintroduced.

Such retroviral vectors of the invention which cannot on their own achieve reverse transcription are also herein identified as reverse transcriptase deficient, reverse transcriptase defective, reverse transcription deficient or reverse transcription defective vectors.

Such retroviral vectors of the invention are deficient for reverse transcription and do not involve formation of DNA intermediates resulting from reverse transcription, either as an integrated double-stranded DNA molecule, as an episomal linear double-stranded DNA molecule or as an episomal circular double-stranded DNA molecule containing one or two LTR(s).

An example of a recombinant retroviral vector according to the invention is a lentiviral vector which cannot on its own achieve complete reverse transcription, wherein the vector comprises a recombinant ribonucleic vector genome comprising a 5' LTR retroviral sequence and a 3' LTR retroviral sequence, preferably flanking a retroviral psi encapsidation sequence and at least one transgene. The recombinant retroviral vector genome possibly further comprises an RNA nuclear export element (for example an Rev responsive element, RRE from HIV-1), a flap sequence (also herein identified as central polypurine tract—central termination sequence, cPPT CTS), a splice donor site (SD), a splice acceptor site (SA), and/or a promoter.

Another object of the invention relates to a composition comprising a retroviral vector according to the invention.

A particular example of such a composition is a pharmaceutical composition (for example, a vaccinal composition) comprising a retroviral vector according to the invention and preferably a pharmaceutically acceptable excipient.

The invention also relates to methods, vectors and compositions for the transient expression of at least one transgene in vitro, ex vivo or in vivo.

The object of the invention is also any method for producing a retroviral vector as defined above in a producer cell, consisting in particular of the expression of appropriate transcomplementation cassettes (resulting in the production of a retroviral enveloped capsid) and of a retroviral recombinant ribonucleic vector genome that will be encapsidated in the retroviral enveloped capsid.

A method according to the present invention is a method for preparing a retroviral vector which cannot on its own achieve complete reverse transcription according to the invention, wherein said method comprises expressing within a cell:

a. a transcomplementation capsid cassette, optionally split into several cassettes, comprising sequences derived from a retroviral genome encoding a retroviral gag sequence, said transcomplementation capsid cassette lacking any functional psi encapsidation signal, wherein said transcomplementation capsid cassette i) comprises a retroviral pol sequence encoding a reverse transcriptase which is non-functional for complete reverse transcription, or ii) does not comprise a reverse transcriptase encoding sequence, b. a transcomplementation envelope cassette encoding for an envelope glycoprotein, and c. a vector cassette encoding for a retroviral recombinant ribonucleic vector genome comprising a 5' LTR retroviral sequence and a 3' LTR retroviral sequence flanking a retroviral psi encapsidation sequence, at least one transgene and possibly at least one post-transcriptional regulatory sequence, and recovery of the retroviral vectors produced.

Another object of the invention is a retroviral vector obtainable with a method as herein described.

Another object of the invention is a nucleic acid sequence comprising a transcomplementation capsid cassette, optionally split into several cassettes, comprising sequences derived from a retroviral genome encoding a retroviral gag sequence, said transcomplementation capsid cassette lacking any functional psi encapsidation signal, wherein said transcomplementation capsid cassette i) comprises a retroviral pol sequence encoding a reverse transcriptase which is non-functional for complete reverse transcription, or ii) does not comprise a reverse transcriptase encoding sequence, and optionally:

a nucleic acid sequence comprising a transcomplementation envelope cassette encoding for an envelope glycoprotein, and/or a nucleic acid sequence comprising a vector cassette encoding for a retroviral recombinant ribonucleic vector genome comprising a 5' LTR retroviral sequence and a 3' LTR retroviral sequence flanking a retroviral psi encapsidation sequence, at least one transgene and possibly at least one post-transcriptional regulatory sequence.

The nucleic acid sequence can be selected for example from a linear nucleic acid sequence, a plasmid, an artificial chromosome, a viral vector genome, and a transposon.

The transcomplementation capsid cassette of the invention allows the expression of elements required for proper encapsidation of the retroviral RNA genome; in other words, allows the assembly of retroviral elements forming a capsid around retroviral RNA genome molecules, said capsid being able to bud from the producing cell, as known by the skilled person. Produced particles are in addition able to enter a host cell through receptor-mediated mechanisms and transduce said cell, i.e., allow the expression of a transgene. In particular, retroviral vectors of the invention allow transgene expression into a target cell without formation of any DNA intermediates in said target cell.

It is known by skilled persons that the gag polyprotein, in particular the nucleocapsid as part of the gag polyprotein, plays a crucial role in genomic RNA packaging and morphogenesis of virus particles and that modification of the gag gene can affect RNA encapsidation (see for instance Darlix J L, Gabus C, Nugeyre M T, Clavel F, Barré-Sinoussi F, Cis elements and trans-acting factors involved in the RNA dimerization of the human immunodeficiency virus HIV-1, J Mol. Biol. 1990 Dec. 5, 216(3):689-99). The role of pol in genomic RNA encapsidation had not been described and skilled persons thought the pol protein was dispensable in retroviral vectors when said retroviral vectors are intended to mediate transient gene expression (e.g., WO 2005/116225). However, as herein described in Example 13, modifications of the pol gene are preferably limited to the RT region and deletions should not encompass protease and integrase regions.

A further object of the invention is a cell or cell line comprising a nucleic acid sequence as herein described, in particular a cell or cell line which does not express a retroviral reverse transcriptase or a cell or cell line expressing, in a stable or a controlled (for example inducible) manner, a retroviral reverse transcriptase comprising a mutation which induces a loss of polymerase and/or RNAseH functions of said reverse transcriptase.

Another object of the invention is a composition, for example a pharmaceutical composition, comprising a vector, a nucleic acid sequence, and/or a cell or a cell line as herein described, and optionally a pharmaceutically acceptable excipient.

Another object of the invention is a kit comprising a vector, a nucleic acid sequence, a cell or a cell line, and/or a composition as herein described, and preferably written instructions for using the kit.

A further object of the invention relates to uses of any product as herein described (vector, nucleic acid sequence, cell, cell line, composition and kit of the invention) for transiently expressing at least one transgene in vitro, ex vivo or in vivo.

DETAILED DESCRIPTION OF THE INVENTION

Unless defined otherwise, all technical and scientific terms used herein have the same meaning as commonly understood by one of ordinary skill in the art (e.g., in cell biology, molecular biology, nucleic acid chemistry and biochemistry). In order to assist with the understanding of the invention several terms are defined herein.

Unless otherwise indicated, the practice of the present invention employs conventional techniques of chemistry, molecular biology, microbiology, recombinant DNA technology, chemical methods, pharmaceutical formulations and delivery and treatment of patients, which are within the capabilities of a person of ordinary skill in the art. Such techniques are also explained in the literature, for example, J. Sambrook, E. F. Fritsch, and T. Maniatis, 1989, Molecular Cloning: A Laboratory Manual, Second Edition, Books 1-3, Cold Spring Harbor Laboratory Press; Ausubel, F. M., et al., 1995 and periodic supplements, Current Protocols in Molecular Biology, ch. 9, 13, and 16, John Wiley & Sons, New York, N.Y.; B. Roe, J. Crabtree, and A. Kahn, 1996, DNA Isolation and Sequencing: Essential Techniques, John Wiley & Sons; J. M. Polak and J. O. D. McGee, 1990, In Situ Hybridisation: Principles and Practice, Oxford University Press; M. J. Gait (Editor), 1984, Oligonucleotide Synthesis: A Practical Approach, IRL Press; and D. M. J. Lilley and J. E. Dahlberg, 1992, Methods of Enzymology: DNA Structure Part A: Synthesis and Physical Analysis of DNA Methods in Enzymology, Academic Press. Each of these general texts is herein incorporated by reference.

The term "amino acid" in the context of the present invention is used in its broadest sense and is meant to include naturally occurring L α-amino acids or residues. The commonly used one- and three-letter abbreviations for naturally occurring amino acids are used herein: A=Ala; C=Cys; D=Asp; E=Glu; F=Phe; G=Gly; H=His; 1=Ile; K=Lys; L=Leu; M=Met; N=Asn; P=Pro; Q=Gln; R=Arg; S=Ser; T=Thr; V=Val; W=Trp; and Y=Tyr (Lehninger, A. L., 1975, Biochemistry, 2 d ed., pp. 71-92, Worth Publishers, New York). The general term "amino acid" may further include D-amino acids and retro-inverso amino acids as well as chemically modified amino acids such as amino acid analogues, naturally occurring amino acids that are not usually incorporated into proteins such as norleucine, and chemically synthesised compounds having properties known in the art to be characteristic of an amino acid, such as β-amino acids. For example, analogues or mimetics of phenylalanine or proline, which allow the same conformational restriction of the peptide compounds as do natural Phe or Pro, are included within the broad definition of amino acid. Such analogues and mimetics are referred to herein as "functional equivalents" of the respective amino acid. Other examples of amino acids are listed by Roberts and Vellaccio, The Peptides: Analysis, Synthesis, Biology, Gross and Meiehofer, eds., Vol. 5, p. 341, Academic Press, Inc., N.Y. 1983, which is incorporated herein by reference.

The term "peptide" as used herein refers to a plurality of amino acids joined together in a linear or circular chain. The term oligopeptide is typically used to describe peptides having between 2 and about 50 or more amino acids. Peptides larger than about 50 amino acids are often referred to as polypeptides or proteins. For purposes of the present invention, however, the term "peptide" is not limited to any particular number of amino acids, and is used interchangeably with the terms "polypeptide" and "protein".

The terms "nucleic acid", "polynucleotide", and "oligonucleotide" are used interchangeably and refer to a deoxyribonucleotide (DNA) or ribonucleotide (RNA) polymer, in linear or circular conformation, in either single- or double-stranded form and in any combination thereof (for example a hybrid DNA/RNA molecule). For the purposes of the present invention such DNA or RNA polymers may include natural nucleotides, non-natural or synthetic nucleotides, and mixtures thereof. Non-natural nucleotides may include analogues of natural nucleotides, as well as nucleotides that are modified in the base, sugar and/or phosphate moieties (e.g., phosphorothioate backbones). Examples of modified nucleic acids are PNAs and morpholino nucleic acids. Generally an analogue of a particular nucleotide has the same base-pairing specificity, i.e., an analogue of G will base pair with C. For the purposes of the invention, these terms are not to be considered limiting with respect to the length of a polymer.

A "gene", as used herein, is the segment of nucleic acid (typically DNA) that is involved in producing a peptide or ribonucleic acid gene product. It includes regions preceding and following the coding region (leader and trailer) as well as intervening sequences (introns) between individual coding segments (exons). Conveniently, this term also includes the necessary control sequences for gene expression (e.g., enhancers, silencers, promoters, terminators etc.), which may be adjacent to or distant from the relevant coding sequence, as well as the coding and/or transcribed regions encoding the gene product.

The phrase "genomic sequence" includes genes and fragments or partial gene sequences. It may refer to non-coding and/or coding gene sequences. Such a genomic sequence may be within a gene, or it may be isolated or extracted from its corresponding gene, such as an isolated nucleic acid molecule, vector or plasmid. Genomic sequences include those present in chromosomes, whether natural or artificial, and whether in the nucleus or other organelles (e.g., mitochondria and chloroplasts). The genomic sequences may be animal (e.g., mammals, such as humans), or may be viral, parasitic, bacterial or fungal (e.g., yeast).

The expressions "in vitro" and "in vivo" each define the other; more precisely, "in vivo" is understood as "in the naturally occurring conditions", while "in vitro" is understood as "in artificial conditions", said conditions being defined by the subject they refer to. For instance, the "naturally occurring conditions" for a cell are "within an organism"; the term "in vivo", when referring to a cell, will thus be understood as "within an organism", while the term "in vitro" will be understood as "out of an organism", for instance in a Petri dish. As another example, the "naturally occurring conditions" for a retroviral integrase are "in the context of a retroviral particle" or "in the context of a retroviral vector particle" (i.e., respectively within said retroviral particle or a cell being infected by said retroviral particle, or within said retroviral vector particle or a cell being transduced by said retroviral vector particle); the term "in vivo", when referring to a retroviral integrase, will then be understood as, for example, "in the context of a retroviral (vector) particle" or "in the context of a cell being infected (or transduced) by said retroviral (vector) particle", while the expression "in vitro" will be understood as "out of a retroviral (vector) particle or a cell", for example "in a solution".

The expression "ex vivo" refers to "in vitro", as previously defined, and usually implies that the subject is transiently taken out of its natural conditions before being reintroduced in vivo, i.e., in its naturally occurring conditions. A typical example of use of the term "ex vivo" is in the context of stem cell manipulation: stem cells are collected from an organism, treated "ex vivo", for instance, submitted to transduction by retroviral vectors, and then reinfused into the organism, i.e., "in vivo".

More specifically in the context of the present invention, when referring to the use of a retroviral vector, the term "in vivo" will refer to the naturally occurring conditions of the target cells, i.e., within an organism, while "in vitro" and "ex vivo" will refer to artificial conditions of the target cells, i.e., out of an organism, for instance in a Petri dish.

As explained previously, there is a need in the art for improved tools and methods allowing the transient expression of a transgene in therapeutic as well as non-therapeutic uses. The present invention provides such improved tools and methods.

The process of "transduction", in contrast to the process of infection which is linked to a replicative virus, is associated with engineered non-replicative particles derived from viruses. In the sense of the invention, the term "transduction" generally relates to "transgene expression". The various steps of this process are briefly described. The transduction process first involves the interaction of the envelope glycoprotein of the retroviral particle with a specific receptor located on the membrane of a target cell, this interaction leading to fusion of the retroviral envelope with the cell membrane. The retroviral capsid is then delivered to the cytoplasm of the target cell. This ribonucleoproteic complex, also known as the preintegration complex, then progresses toward the cell nucleus; meanwhile the retroviral RNA genome may be progressively reverse transcribed. The ribonucleoproteic complex is further processed as it enters the cell nucleus. The double-stranded DNA molecule resulting from the reverse transcription may then be integrated into the host cell chromosomes. Transgene expression may then occur from transcription and transduction of the integrated retroviral vector genome. In this case, transgene expression is persistent. This full schema of the transduction process occurs with traditional retroviral vectors. Retroviral vectors have also been manipulated to block the transduction process at the integration step. In this particular case, the transgene expression mostly results from transcription and transduction of episomal double-stranded DNA molecules (e.g., 2LTR circles); the transgene expression is thus mostly transient when the target cells are dividing. This can be achieved, for instance, through modification of the integrase. A new manipulation of the retroviral vectors to block the transduction process at the reverse transcription stage is herein provided. In the context of the invention, the retroviral particle is modified so that the reverse transcription cannot occur. The ribonucleoproteic complex delivered to the target cell after fusion of the retroviral envelope with the target cell membrane is not processed in the way the RNA molecules it contains are processed into double-stranded molecules. In the context of the invention, the transgene expression does not involve transcription and translation from a DNA intermediate. In the case that the transgene is a coding sequence, transgene expression occurs exclusively from direct translation of the retroviral RNA vector genome. Transgene expression is thus exclusively transient, no matter whether the target cell is dividing or not.

In the sense of the invention, the term "transgene" generally refers to any nucleic acid sequence of interest. This is typically a sequence encoding a peptide, for example an enzyme, a transcription factor, a growth factor, a trophic factor, a hormone, a cytokine, an antibody, a receptor, a differentiation factor, a colony-stimulating factor, a suicide protein, a cell-cycle modifying protein, an anti-proliferative protein, a nuclease, a recombinase, a transposase, a neurotransmitter or a precursor thereof. It can be part of an RNA or DNA molecule. Preferably, it is a sequence derived from a cDNA, a gDNA, an RNA, a synthetic nucleic acid, or a combination thereof. The context will indicate whether the term "transgene" refers to a DNA or an RNA sequence. Typically, the transgene includes a sequence encoding a product of interest. Furthermore, the transgene can include one or more transcription termination regions, typically a polyadenylation signal.

The "transgene" may also typically refer to a non-coding sequence. The transgene can be for example selected from a catalytic nucleic acid (for example a ribozyme), an interfering nucleic acid, an antisense nucleic acid, an aptamer, an miRNA or a decoy RNA.

In the context of the present invention, transient expression vectors relate to retrovirus-derived vectors unable to achieve complete reverse transcription of their genome but able to deliver an RNA and optionally (i.e., when said RNA is a coding RNA) produce a recombinant peptide from the messenger RNA molecules delivered by the vector particles. These retroviral vectors are advantageously able to transiently transfer the transgene to host target cells or organisms.

"Retroviral vectors", in the context of the invention, are defined as engineered vector particles derived from retroviruses such as oncoretroviruses, lentiviruses or spumaviruses. They consist, like the viruses they are derived from, of (i) an envelope made of cell membrane including an envelope glycoprotein, for example derived from an enveloped virus, possibly from a retrovirus or from any other enveloped virus, for example originating from a rhabdovirus, or a cellular glycoprotein or a synthetic glycoprotein—in this case the retroviral vector is designated as "pseudotyped retroviral vector"; and (ii) a capsid, consisting of gag-derived proteins (gag-polyprotein, matrix, capsid, nucleocapsid) containing a nucleic acid genome, namely the "retroviral vector genome", possibly retroviral enzymes derived from the pol gene (protease, integrase and reverse transcriptase), and possibly other retroviral proteins such as regulatory and accessory proteins (for instance tat, nef, rev, etc.). They possibly contain any other peptide of interest brought within the vector particle by means of fusion with one of the naturally encapsidated viral peptides. Retroviral vectors of the invention are defined in that the ribonucleic acid vector genome they enclose has been engineered (i) to be deprived of transcomplementation sequences required for replication, namely gag, pol and env (although fragments thereof may remain, e.g., a partial or complete sequence of the gag gene), and (ii) to contain an expression cassette allowing the expression of at least one transgene of interest when applied to a target cell, said transgene possibly corresponding to gag, pol, env and/or fragments thereof, for instance for a vaccination purpose.

"Reverse transcription" is a step of the viral cycle typical of retroviruses, by which their single-stranded RNA genome is processed into a double-stranded DNA molecule, namely the "provirus". This reaction is mediated by the reverse transcriptase, a retroviral enzyme, and involves two different catalytic activities: a DNA polymerase activity and an RNaseH activity, both of which require divalent cations, typically Mg2+. In addition, the DNA polymerase activity requires deoxynucleotides. The double-stranded DNA molecule resulting from the reverse transcription may exist in a linear form, may be integrated into a host cell chromosome, or may be circularized as a DNA circle containing either 1 or 2 LTR(s).

The present invention more particularly relates to retroviral vectors in which the reverse transcriptase protein is absent or mutated in a way that the reverse transcriptase protein has no or altered polymerase activity or RNAseH activity. Consequently, retroviral vectors of the invention cannot achieve reverse transcription. In other words, retroviral vectors of the invention do not involve any form of double-stranded DNA intermediate (either linear, circular or integrated). These new vectors have been successfully tested by the inventors in therapeutic and non-therapeutic fields as illustrated herein.

A recombinant retroviral vector which cannot on its own achieve complete reverse transcription is thus herein described. Such a retroviral vector of the invention which cannot by itself achieve reverse transcription is also herein identified as a reverse transcriptase deficient, reverse transcriptase defective, reverse transcription deficient or reverse transcription defective vector. This vector comprises a recombinant ribonucleic vector genome, namely the "retroviral vector genome", comprising a 5' LTR retroviral sequence and a 3' LTR retroviral sequence flanking a retroviral psi encapsidation sequence and at least one transgene, for example two, three or four transgenes.

The vector of the invention is a retroviral vector derived from a retrovirus selected from an oncoretrovirus, a spumavirus, a lentivirus and any combination thereof.

Retroviruses, from which vectors of the invention are derived, including oncoretroviruses, lentiviruses and spumaviruses, have gag, pol and env genes flanked by two LTR (Long Terminal Repeat) sequences. Each of these genes encodes for numerous peptides, which are initially expressed in the form of a single precursor polypeptide. The gag gene encodes for the internal structure proteins (matrix, capsid and nucleocapsid). The pol gene encodes for the retroviral enzymes reverse transcriptase, integrase and protease. The env gene encodes for viral envelope glycoprotein. Furthermore, the retroviral genome can contain cis-acting elements, for example elements responsible for exporting out of the nucleus the unspliced viral genomic RNA which will be packaged, such as the RRE (Rev Responsive Element) sequence for HIV. The LTR 5' and 3' sequences serve to promote the transcription and also serve as a polyadenylation sequence of the viral RNAs. Sequences necessary for the initiation of reverse transcription of the genome (binding site of the tRNA primer) and for the encapsidation of viral RNA in particles (psi (Y) site) are adjacent to the LTR 5'. If the sequences necessary for encapsidation (or for packaging retroviral RNA in the infectious virions) are absent from the viral genome, genomic RNA is not actively packaged. Furthermore, the genome of complex retroviruses comprises genes encoding for accessory and/or regulatory proteins (distinct from gag, pol and env proteins) such as, but not limited to (depending on the nature of the virus): src, sag, Tax, vif, vpr, vpx, vpu, nef, TAT, REV, tmx, Tas or Bet (see FIG. 1). For example, the HIV-1 genome contains 7 accessory genes: vif, vpr, vpx, vpu, nef, TAT and REV.

The retroviral vector can be a lentiviral vector derived typically from HIV-1, HIV-2, SIV, FIV, EIAV, BIV, VISNA, or CAEV. It can further be a spumavirus derived typically from the Human Foamy Virus (HFV) or the Primate Foamy Virus (PFV). It can also be an oncoretrovirus derived typically from MLV, GALV, ALV, AMV, BLV, FeLV, HTLV, MMTV, MPMV and RSV. The retroviral vector may further be derived from a combination of any of the previously mentioned retroviruses.

Figure 2:
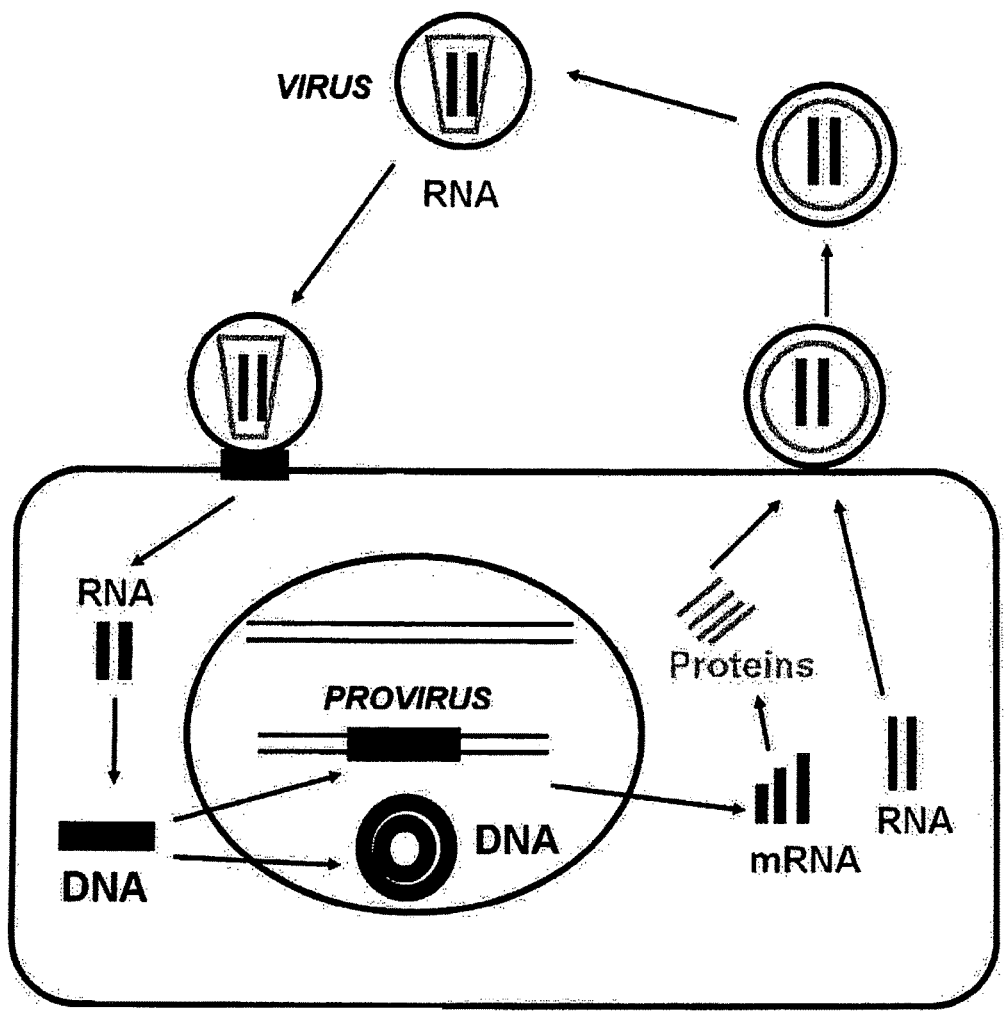
Figure 3:
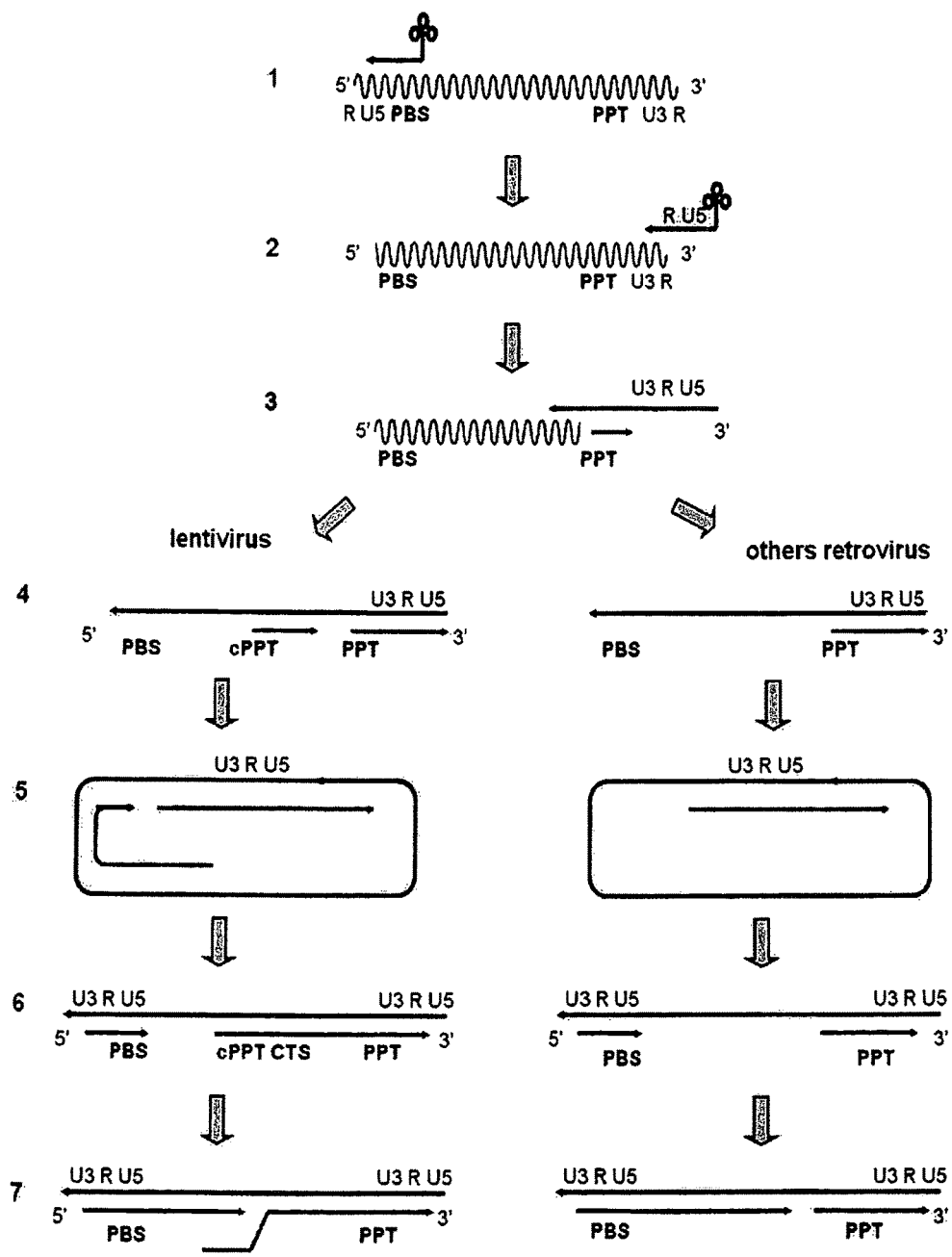

Reverse transcription is a typical step of retroviral cycle (see FIG. 2) and is normally shared by retroviruses and retroviral vectors (see FIG. 3). This reaction is mostly cytoplasmic, although it can be initiated within the particle (before the uncoating step) and be completed after nuclear import within the preintegration complex (PIC). Reverse transcription results in the production within the cell of a double-stranded DNA molecule from the RNA genome. Once the retroviral genome has completely achieved reverse transcription, the double-stranded DNA molecule can be integrated into the genomic DNA of the cell. It can also be circularised to form 2 LTR circles or 1 LTR circle. All the mechanisms leading to the formation of these various DNA forms of the retroviral genome have been extensively reviewed, as it is well-known that they all can serve as templates for transgene expression through transcription and translation (see WO 2005/116225 and Poon D. and Chen I. S. Y. Journal of Virology, vol. 77, No. 7, April 2003, pp. 3962-3972, "Human Immunodeficiency virus type 1 (HIV-1) VPR enhances expression from unintegrated HIV-1 DNA"). It is a multistep process involving three key molecules: the RNA template (with particular nucleic acid sequences and three-dimensional structures), a specific tRNA that serves as a primer for the initiation of the reverse transcription, and the reverse transcriptase (RT) viral enzyme which functions as an RNA- and DNA-dependent DNA polymerase (Pol) and an RNA- and DNA-dependent ribonuclease H (RNAseH) (see FIG. 4 and FIG. 5). The reverse transcriptase polymerase activity is primer-dependent and can transcribe both RNA (RNA-dependent polymerase activity, responsible for the (±) strand synthesis) and DNA (DNA-dependent polymerase activity, responsible for the (−) strand synthesis) templates in a 5'-3' direction. The RNAseH acts on the RNA strand of RNA/DNA duplexes and can catalyse both endo- and exonucleolytic cleavage of such an RNA strand. The RNAseH domain has two particular activities: (a) a polymerase-dependent activity, involved in the degradation of the viral RNA simultaneously with the DNA synthesis, and (b) a polymerase-independent activity, specifically responsible for the degradation of the polypurine tract (PPT).

In a preferred embodiment, the retroviral vector of the invention does not comprise a reverse transcriptase but comprises a recombinant ribonucleic vector genome comprising a 5' LTR retroviral sequence and a 3' LTR retroviral sequence flanking a retroviral psi encapsidation sequence and at least one transgene.

In another preferred embodiment, the retroviral vector of the invention comprises (i) a reverse transcriptase which is non-functional for completing reverse transcription and (ii) a recombinant ribonucleic vector genome comprising a 5' LTR retroviral sequence and a 3' LTR retroviral sequence flanking a retroviral psi encapsidation sequence and at least one transgene.

Further described herein is a retroviral vector of the invention wherein the recombinant ribonucleic vector genome further comprises a deletion of the primer binding site (PBS) sequence.

Skilled persons thought modification of the PBS sequence was sufficient to render the retroviral vector transient (e.g., WO 2005/116225; Galla M. et al., "Retroviral pseudotransduction for targeted cell manipulation," Molecular Cell, Vol. 16, 22 Oct. 2004, pages 309-315). However, Example 14 herein demonstrates that this is not the case: PBS-deficient retroviral vectors retain a high level of integration frequency, revealing the production of DNA. Retroviral vectors of the invention, to prevent formation of DNA, are thus necessarily modified for the reverse transcriptase protein. Alternatively they may contain, in addition to said reverse transcriptase modification, a deletion of the PBS sequence.

In yet another preferred embodiment, the reverse transcriptase of the vector of the invention comprises at least one mutation affecting, preferably abolishing, its polymerase activity and/or its RNAseH activity.

The retroviral vector genome of the invention is properly encapsidated into a retroviral capsid, said capsid being able to bud from a producer cell to generate a retroviral vector particle, said retroviral vector particle being in turn capable of transducing a target cell, i.e., of entering said target cell through interaction of the envelope glycoprotein with the membrane of the target cell, and delivering the uncoated vector particle into the cytoplasm.

In a particular embodiment, the retroviral RNA vector genome will allow the transgene expression by direct translation of said retroviral vector genome.

In another particular embodiment, the retroviral vector genome will be active on its own, for instance when the transgene is a non-coding RNA, such as a decoy RNA, an miRNA, or a ribozyme.

A "mutation" in the context of the invention consists of the modification of the nucleic acid sequence by removing, adding or substituting at least one nucleoside. When the mutated nucleoside sequence is a coding sequence, the nucleoside mutation possibly results in the modification of at least one amino acid in the corresponding peptide; such a mutation is a non-conservative mutation, while a nucleoside mutation resulting in no change in the corresponding peptide, due to the redundancy of the genetic code, is a conservative mutation. In the context of the invention, when a mutation directly refers to a peptide, it is understood that said mutation is the consequence of the corresponding nucleoside mutation affecting the corresponding codon. As an example, a point mutation is understood as the substitution of a single nucleoside when referring to a nucleic acid molecule and as the substitution of single amino acid when referring to a peptide molecule; in the latest case, said point mutation corresponding to the modification of a codon, i.e., the modification of one, two or three nucleosides in the corresponding nucleic acid coding sequence. A "STOP mutation" refers to a modification of a nucleotide sequence resulting in UAG, UAA or UGA on the RNA molecule (corresponding to TAG, TAA or TGA on a DNA molecule). The presence of such a codon on the RNA leads to the termination of the amino acid chain synthesis (translation) so that the translated peptide is truncated.

In the context of the present invention, a mutation "affecting" polymerase activity and/or RNAseH activity is a mutation responsible for the decrease of the respective activities of the reverse transcriptase, typically a decrease of at least 80%, preferably of at least 90%, 95%, 98%, even more preferably of at least 99%, 99.5% or even 99.9% of the activity, when compared to the corresponding activity of the wild-type reverse transcriptase of the virus from which the vector is derived and measured using the G418 clone resistant assay (see Example 8). It is herein considered that a decrease of more than 99.9% of the reverse transcriptase's activity as measured by the G418 clone resistant assay corresponds to the abolition of the reverse transcriptase's activity.

The previously described mutations of the reverse transcriptase can affect the reverse transcription during at least one of the following steps: initiation, elongation, first strand synthesis, second strand synthesis, first jump or second jump.

The previously described mutations of the reverse transcriptase can affect at least one of the following activities of the reverse transcriptase: the RNA-dependent DNA-polymerase activity, the DNA-dependent DNA-polymerase activity, the RNA-dependent RNaseH activity and/or the DNA-dependent RNaseH activity.

These mutations are possibly responsible for defects in the interaction between the reverse transcriptase protein and the RNA matrix, the DNA matrix, the tRNA primer, the PPT primer, the cPPT primer, dNTP and/or Mg2±.

Mutations of the reverse transcriptase can alter its three-dimensional structure directly and/or indirectly so that it modulates (i.e., decreases or abolishes) its polymerase activity (RNA-dependent and or DNA-dependent) and/or its RNAseH activity (polymerase-dependent and/or polymerase-independent), its proper interaction with the RNA template at the initiation site of the reverse transcription during the elongation and/or at any site of the jumps, its proper interaction with the DNA template at the initiation site of the reverse transcription during the elongation and/or at any site of the jumps, its proper interaction with dNTP and/or its proper interaction with divalent ions.

As a result of the mutation of the reverse transcriptase, the retroviral vector genome of the invention cannot be processed into a double-stranded DNA molecule. However, said mutation does not prevent efficient encapsidation of the retroviral vector genome.

In the retroviral vector of the invention containing a coding RNA, transgene expression cannot occur through DNA transcription and translation, and exclusively occurs through direct translation of the retroviral RNA genome.

In the present invention, the reverse transcriptase can be modified or removed so that the reverse transcription process is altered and cannot be completed, i.e., cannot give rise to full-length retroviral double-stranded DNA intermediate molecules in the target cell, and consequently cannot generate a proviral vector genome. This inability to give rise to a full-length double-stranded DNA molecule is the consequence of alteration(s) of the reverse transcription reaction occurring at the initiation step, the elongation, and/or the termination, the first jump and/or the second jump, and/or during the first strand synthesis and/or the second strand synthesis. This inability, in the context of the invention, results from either (i) an absence of the reverse transcriptase protein in the retroviral vector particle or (ii) at least one mutation (as previously defined) in the encapsidated reverse transcriptase peptides.

Amino acid positions of the reverse transcriptase to be advantageously mutated in the context of the invention have been determined by the inventors combining structural data, rational design, literature reports, phylogenetic alignment, combinatory libraries and random mutagenesis to determine the critical positions for polymerase and RNAseH activities of the reverse transcriptase of each virus of interest. Selected mutations should allow proper encapsidation of the retroviral RNA vector genome into the retroviral vector particle formed by the producer cell while preventing formation of double-stranded DNA intermediate from said retroviral RNA vector genome in the target cell.

The inventors have selected the positions of critical residues and identified the possible substitution(s) thereof in the reverse transcriptase of lentiviruses, oncoretroviruses and spumaviruses inducing an alteration or abolition of the reverse transcriptase activity.

Typically for HIV-1 the positions of selected critical residues and corresponding mutations appear in Table 1 and Table 5, for MLV in Table 2 and Table 6, and for SIV, HIV-2, FIV, EIAV, CAEV, VISNA, BIV, ALV and HFV in Table 3 and Table 4.

Critical amino acids identified in Table 1 are presented with their respective numbered positions in HIV-1 reverse transcriptase sequence (herein identified as HIV-1N5 prototypic sequence or SEQ ID NO:1 and corresponding to the reference Swissprot P12497). It is to be noted that corresponding positions in HIV-1 variants (respectively corresponding to SEQ ID NO:2, reference Swissprot 012158, SEQ ID N0:3, reference Swissprot 089290, SEQ ID N0:4, reference Swissprot Q9QBY3, SEQ ID N0:5, reference Swissprot Q9QBZ9, SEQ ID N0:6, reference Swissprot 041798, SEQ ID N0:7, reference Swissprot P03369, SEQ ID N0:8, reference Swissprot Q77373, SEQ ID N0:9, reference Swissprot P03366, SEQ ID N0:10, reference Swissprot P04587, SEQ ID N0:11, reference Swissprot Q73368, SEQ ID N0:12, reference Swissprot P03367, SEQ ID N0:13, reference Swissprot P04589, SEQ ID N0:14, reference Swissprot Q75002, SEQ ID N0:15, reference Swissprot P04585, SEQ ID NO:16, reference Swissprot 089940, SEQ ID NO:17, reference Swissprot Q9WC54, SEQ ID NO:18, reference Swissprot Q9WC63, SEQ ID NO:19, reference Swissprot Q9QBZ1, SEQ ID NO:20, reference Swissprot Q9QBZ5, SEQ ID NO:21, reference Swissprot P04588, SEQ ID NO:22, reference Swissprot P24740, SEQ ID NO:23, reference Swissprot P05959, SEQ ID NO:24, reference Swissprot P20892, SEQ ID NO:25, reference Swissprot POC6F2, SEQ ID NO:26, reference Swissprot P35963, SEQ ID NO:27, reference Swissprot P20875, SEQ ID NO:28, reference Swissprot P05961, SEQ ID NO:29, reference Swissprot P12499, SEQ ID NO:30, reference Swissprot P18802, SEQ ID NO:31, reference Swissprot Q9Q720, SEQ ID NO:32, reference Swissprot 093215, SEQ ID NO:33, reference Swissprot Q91DV9, SEQ ID NO:34, reference Swissprot 091080, and SEQ ID NO:35, reference Swissprot Q79666) can be mutated in an identical way (as explained below) in any variant.

For each position appearing in Table 1, an advantageous substitution, if not a STOP mutation or a deletion, is to be chosen from any one of the amino acids identified.

For example, as described in Table 1, the amino acid R in position 72 of SEQ ID NO:1 (prototypic HIV-1 reverse transcriptase sequence herein identified as SEQ ID NO:1) can be advantageously substituted by a naturally occurring amino acid residue selected from A, C, D, E, F, G, H, K, L, M, N, P, Q, S, T, V, W, and Y (i.e., by any one of the 20 naturally occurring amino acids except R and I).

R amino acid in position 72 is conserved between prototypic HIV-1 N5 of SEQ ID NO:1 and variants thereof (SEQ ID NOS:2 to 35), except in the variant corresponding to SEQ ID NO:5 in which position 72 corresponds to an I residue. Said R residue in position 72 of SEQ ID NOS:1 to 35 except 5 and said I residue in position 72 of SEQ ID NO:5 can be advantageously substituted as described for the corresponding R residue in position 72 of SEQ ID NO:1, i.e., substituted by a naturally occurring amino acid residue selected from A, C, D, E, F, G, H, K, L, M, N, P, Q, S, T, V, W, and Y (i.e., by any one of the 20 naturally occurring amino acids except R and I).

The amino acid D in positions 110, 185, 186, 443, and 498 of SEQ ID NO:1 can be advantageously substituted by a naturally occurring amino acid residue selected from A, C, E, F, G, H, I, K, L, M, N, P, Q, R, S, T, V, W, and Y (i.e., by any of the 19 naturally occurring amino acids different from the native residue D).

The amino acid E in position 478 of SEQ ID NO:1 can be advantageously substituted by a naturally occurring amino acid residue selected from A, C, D, F, G, H, I, K, L, M, N, P, Q, R, S, T, V, W, and Y (i.e., by any of the 19 naturally occurring amino acids different from the native residue E).

The amino acid Y in position 183 of SEQ ID NO:1 can be advantageously substituted by a naturally occurring amino acid residue selected from A, C, D, E, F, G, H, I, K, L, M, N, P, Q, R, S, T, V, and W (i.e., by any of the 19 naturally occurring amino acids different from the native residue Y).

The amino acid E in position 138 of SEQ ID NO:1 can be advantageously substituted by a naturally occurring amino acid residue selected from F, I, L, M, P, V, W, and Y.

The amino acid A in position 355 of SEQ ID NO:1 can be advantageously substituted by a naturally occurring amino acid residue selected from F, P, W, and Y.

Critical amino acids identified in Table 2 are presented with their respective numbered positions in MLV reverse transcriptase sequence analysed (SEQ ID NO:36).

For each position, an advantageous substitution, if not a STOP mutation or a deletion, is to be chosen from any one of the amino acids mentioned.

For example, as described in Table 2, the amino acid Q in position 63 of the MLV reverse transcriptase (SEQ ID NO:36) can be advantageously substituted by A, C, D, E, F, G, H, I, K, L, M, N, P, R, S, T, V, W, and Y (i.e., by any of the 19 amino acids different from the native residue Q).

The amino acid R in position 110 in the MLV reverse transcriptase (SEQ ID NO:36) can be advantageously substituted by a naturally occurring amino acid residue selected from A, C, D, E, F, G, H, I, K, L, M, N, P, Q, S, T, V, W, and Y (i.e., by any of the 19 naturally occurring amino acids different from the native residue R).

The amino acid D in positions 150, 224, 225, 524, and 583 of the MLV reverse transcriptase can be advantageously substituted by a naturally occurring amino acid residue selected from A, C, E, F, G, H, I, K, L, M, N, P, Q, R, S, T, V, W, and Y (i.e., by any of the 19 naturally occurring amino acids different from the native residue D).

The amino acid E in position 562 can be advantageously substituted by a naturally occurring amino acid residue selected from A, C, D, F, G, H, I, K, L, M, N, P, Q, R, S, T, V, W, and Y (i.e., by any of the 19 naturally occurring amino acids different from the native residue E).

The amino acid Y in position 222 can be advantageously substituted by a naturally occurring amino acid residue selected from A, C, D, E, F, G, H, I, K, L, M, N, P, Q, R, S, T, V, and W (i.e., by any of the 19 naturally occurring amino acids different from the native residue Y).

The amino acid K in position 267 can be advantageously substituted by a naturally occurring amino acid residue selected from A, C, D, E, G, N, P, Q, R, S, T, and W.

The amino acid S in position 557 can be advantageously substituted by a naturally occurring amino acid residue selected from A, C, D, E, F, G, H, I, L, M, N, P, Q, T, V, W, and Y.

Critical amino acids identified in Table 3 are presented with their respective numbered positions in each reverse transcriptase sequence analysed from SIV (SEQ ID NO:37—reference Swissprot: Q1A249, also herein identified as SIVEK), HIV-2 (SEQ ID NO:38—reference Swissprot Q89928, also herein identified as HV2EH), FIV (SEQ ID NO:39—reference Swissprot P19028, also herein identified as FIVSD), EIAV (SEQ ID NO:40—reference Swissprot P03371, also herein identified as EIAVY), CAEV (SEQ ID NO:41—reference Swissprot P33459, also herein identified as CAEVC), the Visna virus (SEQ ID NO:42—reference Swissprot P03370, also herein identified as VILV), BIV (SEQ ID NO:43—reference Swissprot P19560, also herein identified as BIV29), ALV (SEQ ID NO:44—reference Swissprot Q7SQ98, also herein identified as ALV), and HFV (SEQ ID NO:45—reference Swissprot P14350, also herein identified as FOAMV).

For each position, an advantageous substitution, if not a STOP mutation or a deletion, is to be chosen from any of the 19 naturally occurring amino acids different from the native amino acid, except for some positions marked with '*'; for these particular positions, refer to Table 4 for advantageous substitutions.

In a first example, as described in Table 3, the amino acid Q in position 23 in SIV (SEQ ID NO:37), HIV-2 (SEQ ID NO:38), and ALV (SEQ ID NO:44), corresponding to the amino acid Q in position 25 in FIV (SEQ ID NO:39), also corresponding to the position 14 in EIAV (SEQ ID NO:40), to the position 18 in CAEV (SEQ ID NO:41), to the position 26 in the Visna virus (SEQ ID NO:42), to the position 36 in BIV (SEQ ID NO:43), and to the position 167 in HFV (SEQ ID NO:45), also corresponding to the position 23 in the HIV-1 prototypic sequence (SEQ ID NO:1) and variants thereof, and to the position 63 in MLV (SEQ ID NO:36), can be advantageously substituted by a naturally occurring amino acid residue selected from A, C, D, E, F, G, H, I, K, L, M, N, P, R, S, T, V, W, and Y (i.e., by any of the 19 naturally occurring amino acids different from the native residue Q).

In another example, as described in the twenty-first line of Table 3, the amino acid D in position 186 in SIV (SEQ ID NO:37) and HIV-2 (SEQ ID NO:38), corresponding to the amino acid D in position 187 in FIV (SEQ ID NO:39), also corresponding to the position 176 in EIAV (SEQ ID NO:40), to the position 180 in CAEV (SEQ ID NO:41), to the position 188 in the Visna virus (SEQ ID N:42), to the position 199 in BIV (SEQ ID NO:43), to the position 183 in ALV (SEQ ID NO:44), and to the position 315 in HFV (SEQ ID NO:45), also corresponding to the position 186 in the HIV-1 prototypic sequence (SEQ ID NO:1) and variants thereof, and to position 225 in MLV (SEQ ID NO:36), can be advantageously substituted by a naturally occurring amino acid residue selected from A, C, E, F, G, H, I, K, L, M, N, P, Q, R, S, T, V, W and Y (i.e., by any of the 19 naturally occurring amino acids different from the native residue D).

In another example, as described on the second line of Table 3, the amino acid P in position 25 in SIV (SEQ ID NO:37) and HIV-2 (SEQ ID NO:38), corresponding to the amino acid P in position 27 in FIV (SEQ ID NO:39), also corresponding to the position 16 in EIAV (SEQ ID NO:40), to the position 20 in CAEV (SEQ ID NO:41), to the position 28 in the Visna virus (SEQ ID NO:42), to the position 38 in BIV (SEQ ID NO:43), to the position 25 in ALV (SEQ ID NO:44), and to the position 169 in HFV (SEQ ID NO:45), also corresponding to the position 25 in the HIV-1 prototypic sequence (SEQ ID NO:1) and variants thereof, and to position 65 in MLV (SEQ ID NO:36), can be advantageously substituted by a naturally occurring amino acid residue selected from A, C, D, E, F, G, H, I, K, L, M, N, Q, R, S, T, V, W and Y (i.e., by any of the 19 naturally occurring amino acids different from the native residue P), except for ALV and HFV, for which substitution is limited to the list presented in Table 4: the position P25 in ALV reverse transcriptase is to be advantageously substituted by an amino acid residue selected from A, C, E, F, I, L, M, V, W, and Y, and the position P169 in HFV reverse transcriptase is to be advantageously substituted by an amino acid residue selected from A, C, D, E, F, G, H, I, L, M, N, Q, S, T, V, W, and Y.

TABLE 1

Critical positions identified in prototypic HIV-1 reverse transcriptase sequence.(HIV-1 N5 of SEQ ID NO: 1) and substitutions advantageously affecting the polymerase activity or the RNAseH activity. For each identified residue, the native amino acid is indicated as well as its position in the reference sequence and the possible substitutions. Any one or several of the identified residues can further be deleted or be concerned by a STOP mutation as herein defined.

| amino acid | position | mutation |
|---|---|---|
| | | POLYMERASE DOMAIN |
| Q | 23 | A C D E F G H I K L M N P — R S T V W Y |
| W | 24 | A C D E F G H I K L M N P Q R S T V — Y |

TABLE 1-continued

Critical positions identified in prototypic HIV-1 reverse transcriptase sequence.(HIV-1 N5 of SEQ ID NO: 1) and substitutions advantageously affecting the polymerase activity or the RNAseH activity. For each identified residue, the native amino acid is indicated as well as its position in the reference sequence and the possible substitutions. Any one or several of the identified residues can further be deleted or be concerned by a STOP mutation as herein defined.

| amino acid | position | mutation |
|---|---|---|
| P | 25  | A C D E F G H I — M N — Q R S T V W Y |
| G | 45  | A C D E F — H I K L M N P Q R S T V W Y |
| P | 52  | A C — E F — H I K L M — — Q R — T V W Y |
| E | 53  | — C — — F — — I — L M — P — — — — V W Y |
| N | 54  | A C — E F — H I — L M — P Q R — T V W Y |
| P | 55  | A C D E F G H I K L M — — Q R S — V W Y |
| N | 57  | A C D E F G H I K L M — P Q R — T V W Y |
| P | 59  | A C D E F G H I K L M N — Q R S T V W Y |
| V | 60  | A C D E F G H — K — M N P Q R S — — W Y |
| F | 61  | A C D E — G H I K L M N P Q R S T V W Y |
| K | 65  | A C D E F G H I — L M N P Q R S T V W Y |
| R | 72  | A C D E F G H — K L M N P Q — S T V W Y |
| L | 74  | A C D E F G H I K — M N P Q R S T V W Y |
| D | 76  | A C — E F G H I K L M — P Q R S T V W Y |
| F | 77  | A C D E — G H I K — M N P Q R S T V W Y |
| R | 78  | A C D E F G H I K L M N P Q — S T V W Y |
| N | 81  | A C D E F G H I K L M — P Q R S T V W Y |
| D | 110 | A C — E F G H I K L M N P Q R S T V W Y |
| V | 111 | A C D E F G H — K L M N P Q R S T — W Y |
| D | 113 | A C — E F — H I K L M N P Q R S T V W Y |
| A | 114 | — C D E F G H I K L M N P Q R S T V W Y |
| Y | 115 | A C D E F G H I K L M N P Q R S T V W — |
| F | 130 | A C D E — G H I K L M N P Q R — T V W Y |
| S | 134 | — C D E F G H I K L M N P Q — — — V W Y |
| I | 135 | — C D E F G H — K — M N — Q R S — — W Y |
| N | 136 | A C D E F G H I K L M — P Q R S T V W Y |
| N | 137 | A C D E F G — I K L M — P Q R S T V W Y |
| E | 138 | — — — — F — — I — L M — P — — — — V W Y |
| T | 139 | — — — — F — H — — — — — — — — — — — W TABLE 1-continued Critical positions identified in prototypic HIV-1 reverse transcriptase sequence.(HIV-1 N5 of SEQ ID NO: 1) and substitutions advantageously affecting the polymerase activity or the RNAseH activity. For each identified residue, the native amino acid is indicated as well as its position in the reference sequence and the possible substitutions. Any one or several of the identified residues can further be deleted or be concerned by a STOP mutation as herein defined.

| amino acid | position | mutation | | | | | | | | | | | | | | | | | | | |
|---|---|---|---|---|---|---|---|---|---|---|---|---|---|---|---|---|---|---|---|---|
| | | A | C | D | E | F | G | H | I | K | L | M | N | P | Q | R | S | T | V | W | Y |
| E | 302 | A | C | D | — | F | G | H | I | K | L | M | N | P | Q | R | S | T | V | W | Y |
| Y | 318 | A | C | D | E | — | G | H | I | K | L | M | N | P | Q | R | S | T | V | W | — |
| T | 351 | — | C | D | E | F | — | H | I | — | — | M | N | — | Q | R | — | — | — | W | Y |
| K | 353 | A | C | D | E | F | G | H | I | — | L | M | N | P | Q | — | S | T | V | W | Y |
| A | 355 | — | C | — | — | F | — | — | — | — | — | — | — | P | — | — | — | — | — | W | Y |
| G | 359 | — | C | — | — | F | — | H | I | — | L | M | — | P | — | — | — | — | V | W | Y |
| K | 374 | A | C | D | E | F | G | — | I | — | L | M | N | P | Q | — | S | T | V | W | Y |
| I | 375 | A | C | D | E | F | G | H | — | K | — | M | N | P | Q | R | S | T | — | W | Y |
| E | 378 | A | C | D | — | F | G | H | I | K | L | M | N | P | Q | R | S | T | V | W | Y |
| G | 384 | A | C | D | E | F | — | H | I | K | L | M | N | P | Q | R | S | T | V | W | Y |
| L | 391 | A | C | D | E | F | G | H | — | K | — | M | N | P | Q | R | S | T | — | W | Y |
| I | 393 | — | C | D | E | — | G | H | — | K | — | — | N | P | Q | R | S | — | — | W | — |
| Q | 394 | — | C | — | — | F | — | H | I | — | — | M | — | — | — | — | — | — | V | W | Y |
| K | 395 | A | C | D | — | F | G | H | I | — | L | M | N | P | Q | — | S | T | V | W | Y |
| E | 396 | A | C | — | — | F | G | H | I | K | L | M | N | P | Q | R | S | T | V | W | Y |
| T | 397 | — | C | — | — | F | — | H | — | — | — | — | — | — | — | — | — | — | — | W | Y |
| W | 398 | A | C | D | E | — | G | H | I | K | L | M | N | P | Q | R | S | T | — | — | — |
| E | 399 | A | C | — | — | F | — | H | I | K | L | M | N | P | Q | — | — | T | V | W | Y |
| A | 400 | — | C | — | — | F | — | — | — | — | — | — | — | P | — | — | — | — | — | W | Y |
| W | 401 | — | C | D | E | — | G | H | — | K | — | — | N | P | Q | — | S | T | — | — | — |
| W | 402 | — | C | D | E | — | G | H | — | K | — | — | N | P | Q | R | S | T | — | — | Y |
| W | 406 | — | C | — | E | F | G | H | I | K | — | M | N | P | Q | — | S | — | — | — | Y |
| W | 410 | — | C | D | E | F | G | H | I | K | L | M | N | P | Q | R | S | T | V | — | Y |
| P | 412 | A | C | D | E | F | G | H | I | K | L | M | — | Q | R | S | T | V | W | Y | |
| W | 414 | — | C | D | E | — | G | H | — | K | — | — | N | P | Q | R | S | T | — | — | — |
| P | 420 | A | C | D | E | F | — | H | I | K | L | M | N | — | Q | R | — | — | V | W | Y |
| P | 421 | A | C | D | E | F | G | — | I | — | L | M | N | — | — | — | S | — | V | W | Y |
| L | 422 | — | C | D | E | — | G | H | — | K | — | M | N | P | Q | R | S | — | — | W | — |
| V | 423 | — | C | D | E | — | G | H | — | K | — | — | N | P | Q | R | S | — | — | W | — |
| RNaseH DOMAIN | | | | | | | | | | | | | | | | | | | | | |
| F | 440 | A | C | D | E | — | G | H | — | K | L | M | N | P | Q | R | S | T | V | — | — |
| Y | 441 | A | C | D | E | F | G | H | I | K | L | M | N | P | Q | R | S | T | V | W | — |
| D | 443 | A | C | — | E | F | G | H | I | K | L | M | N | P | Q | R | S | T | V | W | Y |
| R | 448 | A | C | D | E | F | G | H | I | — | L | M | N | P | Q | — | S | T | V | W | Y |
| K | 451 | A | C | D | E | F | — | H | I | — | L | M | N | P | — | — | S | T | V | W | Y |
| T | 473 | A | C | D | E | F | G | H | I | K | L | M | N | P | Q | R | — | — | V | W | Y |
| N | 474 | A | C | D | E | F | G | — | I | K | L | M | — | P | Q | R | S | T | V | W | Y |
| Q | 475 | A | C | D | E | F | G | H | I | K | L | M | N | P | — | R | S | T | V | W | Y |
| K | 476 | A | C | D | — | F | G | H | I | — | L | M | N | P | — | — | S | T | V | W | Y |
| E | 478 | A | C | D | — | F | G | H | I | K | L | M | N | P | Q | R | S | T | V | W | Y |
| A | 481 | — | C | D | E | F | G | H | I | K | L | M | N | P | Q | R | S | T | V | W | Y |
| A | 485 | — | C | D | E | F | G | H | I | K | L | M | N | P | Q | R | S | T | V | W | Y |
| I | 495 | A | C | D | E | F | G | H | — | K | — | M | N | P | Q | R | S | T | V | W | Y |
| D | 498 | A | C | — | E | F | G | H | I | K | L | M | N | P | Q | R | S | T | V | W | Y |

TABLE 2-continued

Critical positions identified in MLV reverse transcriptase sequence (SEQ ID NO: 36) and substitutions advantageously affecting the polymerase activ TABLE 2-continued Critical positions identified in MLV reverse transcriptase sequence (SEQ ID NO: 36) and substitutions advantageously affecting the polymerase activity or the RNAseH activity. For each identified residue, the native amino acid is indicated as well as its position in the reference sequence and the possible substitutions. Any one or several of the identified residues can further be deleted or be concerned by a STOP mutation as herein defined.

| amino acid | position | mutation | | | | | | | | | | | | | | | | | | | |
|---|---|---|---|---|---|---|---|---|---|---|---|---|---|---|---|---|---|---|---|---|---|
| RNaseH DOMAIN | | | | | | | | | | | | | | | | | | | | | |
| Y | 522 | A | C | D | E | — | G | H | — | K | L | M | N | P | Q | R | S | T | V | — | — |
| D | 524 | A | C | — | E | F | G | H | I | K | L | M | N | P | Q | R | S | T | V | W | Y |
| L | 529 | A | C | — | E | F | G | H | I | K | — | M | N | P | Q | R | S | T | V | W | Y |
| S | 557 | A | C | D | E | F | G | H | I | — | L | M | N | P | Q | — | — | T | V | W | Y |
| A | 558 | — | C | D | E | F | — | H | I | — | L | M | N | P | — | — | S | T | V | W | Y |
| Q | 559 | A | C | D | E | F | G | H | I | K | L | M | N | P | — | R | — | — | V | W | Y |
| R | 560 | A | C | D | E | F | G | — | I | K | L | M | — | P | Q | — | S | T | V | W | Y |
| E | 562 | A | C | D | — | F | G | H | I | K | L | M | N | P | Q | R | S | T | V | W | Y |
| A | 565 | — | C | D | — | F | G | H | I | — | L | M | N | P | — | — | S | T | V | W | Y |
| A | 569 | — | C | D | — | F | G | H | I | K | L | M | N | P | Q | R | S | T | V | W | Y |
| D | 583 | A | C | — | E | F | G | H | I | K | L | M | N | P | Q | R | S | T | V | W | Y |
| S | 584 | — | C | D | E | F | G | H | I | K | L | M | N | P | Q | R | — | T | V | W | Y |
| R | 585 | A | C | D | E | F | G | H | — | K | — | M | N | P | Q | — | S | T | V | W | Y |
| Y | 586 | A | C | — | E | F | G | H | I | K | L | M | N | P | Q | R | S | T | V | W | — |
| T | 590 | A | C | D | E | F | G | H | I | K | L | M | N | P | Q | R | — | — | V | W | Y |
| H | 638 | A | C | D | E | F | G | — | I | — | L | M | N | P | — | — | S | T | V | W | Y |
| G | 648 | A | C | D | E | F | — | H | I | K | L | M | N | P | Q | R | S | T | V | W | Y |
| D | 653 | A | C | — | E | F | G | H | I | K | L | M | N | P | Q | R | S | T | V | W | — |

TABLE 3

Critical positions identified in retroviral reverse transcriptase sequences of SIV (SEQ ID NO: 37—reference Swissprot: Q1A249, also herein identified as SIVEK), HIV-2 (SEQ ID NO: 38—reference Swissprot Q89928, also herein identified as HV2EH), FIV (SEQ ID NO: 39—reference Swissprot P19028, also herein identified as FIVSD), EIAV (SEQ ID NO: 40—reference Swissprot P03371, also herein identified as EIAVY), CAEV (SEQ ID NO: 41—reference Swissprot P33459, also herein identified as CAEVC), Visna virus (SEQ ID NO: 42—reference Swissprot P03370, also herein identified as VILV), BIV (SEQ ID NO: 43—reference Swissprot P19560, also herein identified as BIV29), ALV (SEQ ID NO: 44—reference Swissprot Q7SQ98, also herein identified as ALV), and HFV (SEQ ID NO: 45—reference Swissprot P14350, also herein identified as FOAMV) and substitutions advantageously affecting the polymerase activity or the RNAseH activity. For each identified residue, the native amino acid can be substituted by any one of the naturally occurring amino acid distinct from the native one except for the positions indicated with "*", i.e.: P25, R69, Y180, Q481, A487 and A491 in ALV, and P169, D217 in HFV. For these positions, advantageous substitutions are indicated in Table 4.
Any one or several of the identified residues can further be deleted or be concerned by a STOP mutation as herein defined.

| SIVEK Q1A249 | HV2EH Q89928 | FIVSD P19028 | EIAVY P03371 | CAEVC P33459 | VILV P03370 | BIV29 P19560 | ALV Q75Q98 | FOAMV P14350 |
|---|---|---|---|---|---|---|---|---|
| Q23 | Q23 | Q25 | Q14 | Q18 | Q26 | Q36 | Q23 | Q167 |
| P25 | P25 | P27 | P16 | P20 | P28 | P38 | P25* | P169* |
| G45 | G45 | G47 | G36 | G40 | G48 | G58 | G45 | G189 |
| N57 | N57 | N59 | N48 | N52 | N60 | N70 | N55 | N199 |
| P59 | P59 | P61 | P50 | P54 | P62 | P72 | P57 | P201 |
| K65 | K65 | K67 | K56 | K60 | K68 | K78 | K63 | K207 |
| R72 | R72 | R73 | R62 | R66 | R74 | R85 | R69* | R213 |
| D76 | D76 | D77 | D66 | D70 | D78 | D89 | D73 | D217* |
| R78 | R78 | R79 | R68 | R72 | R80 | R91 | R75 | R219 |
| N81 | N81 | N82 | N71 | N75 | N83 | N94 | N78 | N222 |
| D110 | D110 | D111 | D100 | D104 | D112 | D123 | D107 | D252 |
| F130 | F130 | F131 | F120 | F124 | F132 | F143 | F127 | F272 |
| L149 | L149 | L150 | L139 | L143 | L151 | L162 | L146 | L284 |
| P150 | P150 | P151 | P140 | P144 | P152 | P163 | P147 | P285 |
| Q151 | Q151 | Q152 | Q141 | Q145 | Q153 | Q164 | Q148 | Q286 |
| G152 | G152 | G153 | G142 | G146 | G154 | G165 | G149 | G287 |
| S156 | S156 | S157 | S146 | S150 | S158 | S169 | S153 | S291 |
| P157 | P157 | P158 | P147 | P151 | P159 | P170 | P154 | P292 |
| Y183 | Y183 | Y184 | Y173 | Y177 | Y185 | Y196 | Y180* | Y312 |
| D185 | D185 | D186 | D175 | D179 | D187 | D198 | D182 | D314 |
| D186 | D186 | D187 | D176 | D180 | D188 | D199 | D183 | D315 |
| G384 | G383 | G386 | G372 | G375 | G383 | G390 | G381 | G519 |
| D443 | D442 | D447 | D430 | D432 | D440 | D446 | D450 | D599 |
| Q475 | Q474 | Q477 | Q460 | Q461 | Q469 | Q474 | Q481* | Q643 |
| E478 | E477 | E480 | E463 | E464 | E472 | E477 | E484 | E646 |
| A481 | A480 | A483 | A466 | A467 | A475 | A480 | A487* | A649 |
| A485 | A484 | A487 | A470 | A471 | A479 | A484 | A491* | A653 |

TABLE 3-continued

Critical positions identified in retroviral reverse transcriptase sequences of SIV (SEQ ID NO: 37—reference Swissprot: Q1A249, also herein identified as SIVEK), HIV-2 (SEQ ID NO: 38—reference Swissprot Q89928, also herein identified as HV2EH), FIV (SEQ ID NO: 39—reference Swissprot P19028, also herein identified as FIVSD), EIAV (SEQ ID NO: 40—reference Swissprot P03371, also herein identified as EIAVY), CAEV (SEQ ID NO: 41—reference Swissprot P33459, also herein identified as CAEVC), Visna virus (SEQ ID NO: 42—reference Swissprot P03370, also herein identified as VILV), BIV (SEQ ID NO: 43—reference Swissprot P19560, also herein identified as BIV29), ALV (SEQ ID NO: 44—reference Swissprot Q7SQ98, also herein identified as ALV), and HFV (SEQ ID NO: 45—reference Swissprot P14350, also herein identified as FOAMV) and substitutions advantageously affecting the polymerase activity or the RNAseH activity. For each identified residue, the native amino acid can be substituted by any one of the naturally occurring amino acid distinct from the native one except for the positions indicated with "*", i.e.: P25, R69, Y180, Q481, A487 and A491 in ALV, and P169, D217 in HFV. For these positions, advantageous substitutions are indicated in Table 4.
Any one or several of the identified residues can further be deleted or be concerned by a STOP mutation as herein defined.

| SIVEK Q1A249 | HV2EH Q89928 | FIVSD P19028 | EIAVY P03371 | CAEVC P33459 | VILV P03370 | BIV29 P19560 | ALV Q7SQ98 | FOAMV P14350 |
|---|---|---|---|---|---|---|---|---|
| D498 | D497 | D500 | D484 | D484 | D492 | D497 | D505 | D669 |
| S499 | S498 | S501 | S485 | S485 | S493 | S498 | S506 | S670 |

TABLE 4

See legend of Table 3
ALV (SEQ ID NO: 44—reference Swissprot Q7SQ98, also herein identified as ALV), and
HFV (SEQ ID NO: 45—reference Swissprot P14350, also herein identified as FOAMV)

|  | amino acid | position | mutation | | | | | | | | | | | | | | | | | | |
|---|---|---|---|---|---|---|---|---|---|---|---|---|---|---|---|---|---|---|---|---|---|
| ALV Q7SQ98 | P | 25  | A | C | — | E | F | — | — | I | — | L | M | — | — | — | — | — | — | V | W | Y |
|  | R | 69  | A | C | D | E | F | G | — | I | — | L | M | N | P | Q | — | S | T | V | W | Y |
|  | Y | 180 | A | C | D | E | — | G | H | I | K | L | M | N | P | Q | R | S | T | V | W | — |
|  | Q | 481 | A | C | D | E | F | G | H | I | — | L | M | N | P | — | — | S | T | V | W | Y |
|  | A | 487 | — | C | D | E | F | G | H | I | K | L | M | N | P | Q | R | S | T | — | W | Y |
|  | A | 491 | — | C | D | E | F | G | H | — | K | — | M | N | P | Q | R | — | — | — | W | Y |
| FOAMV P14350 | P | 169 | A | C | D | E | F | G | N | I | — | L | M | N | — | Q | — | S | T | V | W | Y |
|  | D | 217 | A | C | — | E | F | — | H | I | K | L | M | N | P | Q | R | S | T | V | W | Y |

In an embodiment, a typical vector of the present invention comprises a reverse transcriptase which is non-functional for completing reverse transcription and is:

i) from the HIV-1 (prototypic HIV-1N5 serotype) reverse transcriptase of SEQ ID NO:1, or any variants thereof, for example of SEQ ID NO:2-35, and is mutated, the mutation being selected from a deletion of at least one residue or encompassing at least one residue appearing in Table 1, from a substitution identified in Table 1, and from any combinations thereof, ii) from the MLV reverse transcriptase of SEQ ID NO:36, or any variants thereof, and is mutated, the mutation being selected from a deletion of at least one residue or encompassing at least one residue appearing in Table 2, from a substitution identified in Table 2, and from any combinations thereof, iii) from the SIV reverse transcriptase of SEQ ID NO:37, or any variants thereof, iv) from the HIV-2 reverse transcriptase of SEQ ID NO:38, or any variants thereof, v) from the FIV reverse transcriptase of SEQ ID NO:39, or any variants thereof, vi) from the EIAV reverse transcriptase of SEQ ID NO:40, or any variants thereof, vii) from the CAEV reverse transcriptase of SEQ ID NO:41, or any variants thereof, viii) from the VISNA reverse transcriptase of SEQ ID NO:42, or any variants thereof, ix) from the BIV reverse transcriptase of SEQ ID NO:43, or any variants thereof, x) from the ALV reverse transcriptase of SEQ ID N0:44, or any variants thereof, and xi) from the HFV reverse transcriptase of SEQ ID NO:45, or any variants thereof, and is mutated, the mutation being selected from any deletion of at least one residue, or encompassing at least one residue for each corresponding sequence appearing in Table 3, from any substitution identified for each corresponding sequence identified in Table 3 and Table 4, and from any combinations thereof.

Moreover, the inventors have determined the positions in which introduction of STOP codons alters or abolishes activity of reverse transcriptase of lentiviruses, oncoretroviruses and spumaviruses.

In an embodiment, a typical vector of the present invention therefore comprises a reverse transcriptase non-functional for completing reverse transcription which is:

i) from the HIV-1 reverse transcriptase of SEQ ID NO:1, or any variants thereof, for example of SEQ ID NOS:2-35, and is mutated, the mutation being responsible for the introduction of a STOP codon between residues selected from positions 1 to 550 of the HIV-1 reverse transcriptase of SEQ ID NOS:1 to 35, ii) from the MLV reverse transcriptase of SEQ ID NO:36, or any variants thereof, and is mutated, the mutation being responsible for the introduction of a STOP codon between residues selected from positions 1 to 654 of the MLV reverse transcriptase of SEQ ID NO:36, iii) from the SIV-1 reverse transcriptase of SEQ ID NO:37 and is mutated, the mutation being responsible for the introduction of a STOP codon between residues selected from positions 1 to 500 of the SIV-1 reverse transcriptase of SEQ ID NO:37, iv) from the HIV-2 reverse transcriptase of SEQ ID NO:38 and is mutated, the mutation being responsible for the introduction of a STOP codon between residues selected from positions 1 to 499 of the HIV-2 reverse transcriptase of SEQ ID NO:38, v) from the FIV reverse transcriptase of SEQ ID NO:39 and is mutated, the mutation being responsible for the introduction of a STOP codon between residues selected from positions 1 to 502 of the FIV reverse transcriptase of SEQ ID NO:39, vi) from the EIAV reverse transcriptase of SEQ ID NO:40 and is mutated, the mutation being responsible for the introduction of a STOP codon between residues selected from positions 1 to 486 of the EIAV reverse transcriptase of SEQ ID NO:40, vii) from the CAEV reverse transcriptase of SEQ ID NO:41 and is mutated, the mutation being responsible for the introduction of a STOP codon between residues selected from positions 1 to 486 of the CAEV reverse transcriptase of SEQ ID NO:41, viii) from the VISNA reverse transcriptase of SEQ ID NO:42 and is mutated, the mutation being responsible for the introduction of a STOP codon between residues selected from positions 1 to 494 of the VISNA reverse transcriptase of SEQ ID NO:42, ix) from the BIV reverse transcriptase of SEQ ID NO:43 and is mutated, the mutation being responsible for the introduction of a STOP codon between residues selected from positions 1 to 499 of the BIV reverse transcriptase of SEQ ID NO:43, x) from the ALV reverse transcriptase of SEQ ID NO:44 and is mutated, the mutation being responsible for the introduction of a STOP codon between residues selected from positions 1 to 507 of the ALV reverse transcriptase of SEQ ID NO:44, and xi) from the HFV reverse transcriptase of SEQ ID NO:45 and is mutated, the mutation being responsible for the introduction of a STOP codon between residues selected from positions 1 to 671 of the HFV reverse transcriptase of SEQ ID NO:45, or any variants thereof.

In a particular embodiment, the residues of the reverse transcriptase, mutation of which affects the HIV-1 reverse transcriptase activity in the polymerase domain and/or the RNAseH domain, are selected from Q23, W24, P25, G45, P52, E53, N54, P55, N57, P59, V60, F61, K65, R72, L74, D76, F77, R78, N81, D110, V111, D113, A114, Y115, F130, S134, 1135, N136, N137, E138, T139, P140, L149, P150, Q151, G152, K154, S156, P157, Y181, Y183, M184, D185, D186, Y188, G190, W229, M230, G231, Y232, N255, D256, 1257, Q258, K259, L260, V261, G262, K263, L264, N265, W266, C280, K281, L282, L283, R284, G285, T286, K287, A288, L289, T290, E302, Y318, T351, K353, A355, K355, G359, K374, 1375, E378, G384, L391, 1393, Q394, K395, E396, T397, W398, E399, A400, W401, W402, W406, W410, P412, W414, P420, P421, L422, V423, F440, Y441, D443, R448, K451, T473, N474, Q475, K476, E478, A481, A485, 1495, D498, S499, Q500, Y501, H539, and D549 of SEQ ID NO:1.

In another particular embodiment, residues of the reverse transcriptase, mutation of which affects the HIV-1 reverse transcriptase activity in the polymerase domain, are preferably selected from K65, R72, D110, Y115, F116, Q151, F160, Y183, M184, D185, and D186 (residues involved in the DNA polymerase catalytic centre, also herein identified as the hydrophobic dNTP binding pocket) of SEQ ID NO:1 and any combination thereof.

An example of a preferred mutation is a non-conservative substitution of the Aspartic acid (D) residue 110, encoded by the codon GA<u>T</u> or the codon GA<u>C</u>, by a Glutamic acid (E) residue, encoded by the codon GA<u>A</u> or the codon GA<u>G</u> (for example the codon GAG in position 2642, 2643, and 2644 in SEQ ID NO:48); this particular mutation is also herein identified as mutation D110E. Further preferred mutations in the HIV-1 reverse transcriptase polymerase domain are herein exemplified (see Table 5).

In a further particular embodiment, residues of the reverse transcriptase, mutation of which affects the HIV-1 reverse transcriptase activity in the RNAseH domain, are preferably selected from D443, E478, D498, H539 and D549 (residues involved in the RNAseH catalytic site) of SEQ ID NO:1 and any combination thereof.

An example of a preferred mutation is a non-conservative substitution of the Glutamic acid (E) residue 478, encoded by the codon <u>G</u>AA or the codon <u>G</u>AG, by a Glutamine (Q) residue, encoded by the codon <u>C</u>AA or the codon <u>C</u>AG (for example the codon CAG in positions 4046, 4047, and 4048 in SEQ ID NO:51), also herein identified as mutation E478Q. Further preferred mutations in the HIV-1 reverse transcriptase RNAseH domain are herein exemplified (see Table 5).

In another particular embodiment, the HIV-1 reverse transcriptase contains a D110E substitution affecting its polymerase activity and an E478Q substitution affecting its RNAseH activity.

In another particular embodiment, a mutation affecting the HIV-1 reverse transcriptase is a substitution of the Proline residue (P) in position 25 of SEQ ID NO:1 by a naturally occurring amino acid residue selected from A, C, D, E, F, G, H, 1, K, L, M, N, Q, R, S, T, V, W and Y (SEQ ID NO:84). As an example, said P residue, encoded by a codon selected from CCT, CCC, CCA and CCG, is substituted by a Glutamine (Q) residue, encoded by the codon CAA or the codon CAG; this particular mutation is also herein identified as mutation P25Q.

In another particular embodiment, a mutation affecting the HIV-1 reverse transcriptase is a substitution of the Aspartic acid residue (D) in position 113 of SEQ ID NO:1 by a naturally occurring amino acid residue selected from A, C, E, F, G, H, I, K, L, M, N, P, Q, R, S, T, V, W and Y (SEQ ID NO:84). As an example, said Q residue, encoded by the codon CAA or the codon CAG, is substituted by a Phenylalanine (F) residue, encoded by the codon TTT or the codon TTC; this particular mutation is also herein identified as mutation D113F.

In another particular embodiment, a mutation affecting the HIV-1 reverse transcriptase is a substitution of the Tyrosine residue (Y) in position 232 of SEQ ID NO:1 by a naturally occurring amino acid residue selected from A, C, D, E, G, H, I, K, L, M, N, P, Q, R, S, T, V and W (SEQ ID NO:84). As an example, said Y residue, encoded by the codon TAT or the codon TAC, is substituted by a Valine (V) residue, encoded by a codon selected from GTT, GTC, GTA and GTG; this particular mutation is also herein identified as mutation Y232V.

In another particular embodiment, a mutation affecting the HIV-1 reverse transcriptase is a substitution of the Threonine residue (T) in position 351 of SEQ ID NO:1 by a naturally occurring amino acid residue selected from C, D, E, F, H, I, M, N, Q, R, W and Y (SEQ ID NO:84). As an example, said T residue, encoded by a codon selected from ACT, ACC, ACA and ACG, is substituted by a Histidine (H) residue, encoded by the codon CAT or the codon CAC; this particular mutation is also herein identified as mutation T351H.

In another particular embodiment, a mutation affecting the HIV-1 reverse transcriptase is a substitution of the Proline residue (P) in position 420 of SEQ ID NO:1 by a naturally occurring amino acid residue selected from A, C, D, E, F, H, I, K, L, M, N, Q, R, V, W and Y (SEQ ID NO:84). As an example, said P residue, encoded by a codon selected from CCT, CCC, CCA and CCG, is substituted by a Cysteine (C) residue, encoded by the codon TGT or the codon TGC; this particular mutation is also herein identified as mutation P420C.

In another particular embodiment, a mutation affecting the HIV-1 reverse transcriptase is a substitution of the Histidine residue (H) in position 539 of SEQ ID NO:1 by a naturally occurring amino acid residue selected from A, C, D, E, F, G, I, K, L, M, N, P, Q, R, S, T, V, W and Y (SEQ ID NO:84). As an example, said H residue, encoded by the codon CAT or the codon CAC, is substituted by an Isoleucine (I) residue, encoded by a codon selected from ATT, ATC and ATA; this mutation is also herein identified as mutation H539I.

In a particular embodiment, the residues of the reverse transcriptase, mutation of which affects the MLV reverse transcriptase activity in the polymerase domain and/or the RNAseH domain, are selected from Q63, P65, G85, N95, P97, K103, R110, D114, R116, N119, D150, K152, D153, A154, F155, F156, F170, L188, P189, Q190, G191, K193, S195, P196, R211, Y222, V223, D224, D225, K267, Y268, L269, G270, Y271, L272, L273, K274, K295, T296, P297, R298, Q299, L300, R301, E302, F303, L304, G305, T306, A307, G308, F309, C310, R311, L312, W313, I314, P315, G316, F317, A318, Y325, L326, L327, T330, L333, A343, L359, V402, A403, A404, A423, G429, V470, P487, Y522, D524, L529, S557, A558, Q559, R560, E562, A565, A569, D583, S584, R585, Y586, T590, H638, G648 and D653 of SEQ ID NO:36.

In another particular embodiment, residues of the reverse transcriptase, mutation of which affects the MLV reverse transcriptase activity in the polymerase domain, are preferably selected from D150, D153, F155, F156, Q190, Y222, V223, D224, and D225 (residues involved in the DNA polymerase catalytic centre, also herein identified as the hydrophobic dNTP binding pocket) of SEQ ID NO:36, and any combination thereof.

An example of a preferred mutation is a non-conservative substitution of the Aspartic acid (D) residue, encoded by the codon GAT or the codon GAC, in position 150 by a Glutamic acid (E) residue, encoded by the codon GAA or the codon GAG (for example the codon GAG in position 3279, 3280, and 3281 in SEQ ID NO: 58); this particular mutation is also herein identified as mutation D150E. Further preferred mutations of the MLV reverse transcriptase polymerase domain are herein exemplified (see Table 6).

In a further particular embodiment, residues of the reverse transcriptase, mutation of which affects the MLV reverse transcriptase activity in the RNAseH domain, are preferably selected from D524, E562, D583, and D653 (residues involved in the RNAseH catalytic site) of SEQ ID NO:36, and any combination thereof.

An example of a preferred mutation is a non-conservative substitution of the Glutamic acid (E) residue, encoded by the codon GAA or the codon GAG, in position 562 of SEQ ID NO:36 by a Glutamine (Q) residue, encoded by the codon CAA or the codon CAG (for example the codon CAA in positions 4515, 4516, and 4517 in SEQ ID NO:60); this particular mutation is also herein identified as mutation E562Q. Further preferred mutations of the MLV reverse transcriptase RNAseH domain are herein exemplified (see Table 6).

In another particular embodiment, the MLV reverse transcriptase contains a D150E substitution affecting its polymerase activity and an E562Q substitution affecting its RNAseH activity.

In another particular embodiment, a mutation affecting the MLV reverse transcriptase is a substitution of the Proline residue (P) in position 65 of SEQ ID NO:36 by a naturally occurring amino acid residue selected from A, C, D, E, F, G, H, I, K, L, M, N, Q, R, S, T, V and Y (SEQ ID NO:85). As an example, said P residue, encoded by a codon selected from CCT, CCC, CCA and CCG, is substituted by an Arginine (R) residue, encoded by a codon selected from CGT, CGC, CGA, CGG, AGA and AGG; this mutation is also herein identified as mutation P65R.

In another particular embodiment, a mutation affecting the MLV reverse transcriptase is a substitution of the Aspartic acid residue (D) in position 153 of SEQ ID NO:36 by a naturally occurring amino acid residue selected from A, C, E, G, H, I, K, M, N, P, Q, R, S, T, V, W and Y (SEQ ID NO:85). As an example, said D residue, encoded by the codon GAT or the codon GAC, is substituted by a Glutamine (Q) residue, encoded by the codon CAA or the codon CAG; this particular mutation is also herein identified as mutation D153Q.

In another particular embodiment, a mutation affecting the MLV reverse transcriptase is a substitution of the Tyrosine residue (Y) in position 268 of SEQ ID NO:36 by a naturally occurring amino acid residue selected from A, C, D, E, F, G, H, I, L, K, L, M, N, P, Q, R, S, T, V and W (SEQ ID NO:85). As an example, said Y residue, encoded by the codon TAT or the codon TAC, is substituted by a Leucine (L) residue, encoded by a codon selected from TTA, TTG, CTT, CTC, CTA and CTG; this particular mutation is also herein identified as mutation Y268L.

In another particular embodiment, a mutation affecting the MLV reverse transcriptase is a substitution of the Alanine residue (A) in position 318 of SEQ ID NO:36 by a naturally occurring amino acid residue selected from C, D, E, F, G, H, I, L, M, N, P, Q, S, V, W and Y (SEQ ID NO:85). As an example, said A residue, encoded by a codon selected from GCT, GCC, GCA and GCG, is substituted by a Histidine (H) residue, encoded by the codon CAT or the codon CAC; this particular mutation is also herein identified as mutation A318H.

In another particular embodiment, a mutation affecting the MLV reverse transcriptase is a substitution of the Valine residue (V) in position 402 of SEQ ID NO:36 by a naturally occurring amino acid residue selected from A, C, D, E, F, G, H, I, K, L, N, P, Q, R, S, T, W and Y (SEQ ID NO:85). As an example, said V residue, encoded by a codon selected from GTT, GTC, GTA and GTG, is substituted by an Aspartic acid (D) residue, encoded by the codon GAT or the codon GAC; this particular mutation is also herein identified as mutation V402D.

In another particular embodiment, a mutation affecting the MLV reverse transcriptase is a substitution of the Serine residue (S) in position 557 of SEQ ID NO:36 by a naturally occurring amino acid residue selected from A, C, D, E, F, G, H, I, L, M, N, P, Q, T, V, W and Y (SEQ ID NO:85). As an example, said S residue, encoded by a codon selected from TCT, TCC, TCA, TCG, AGT and AGC, is substituted by a Glutamic acid (E) residue, encoded by the codon GAA or the codon GAG; this particular mutation is also herein identified as mutation S557E.

In another particular embodiment, a mutation affecting the MLV reverse transcriptase is a substitution of the Histidine residue (H) in position 638 of SEQ ID NO:36 by a naturally occurring amino acid residue selected from A, C, D, E, F, G, I, L, M, N, P, S, T, V, W and Y (SEQ ID NO:85). As an example, said H residue, encoded by the codon CAT or the codon CAC, is substituted by an Alanine (A) residue, encoded by a codon selected from GCT, GCC, GCA and GCG; this particular mutation is also herein identified as mutation H638A.

In a particular embodiment, the residues of the reverse transcriptase, mutation of which affects the SIV reverse transcriptase activity in the polymerase domain and/or the RNAseH domain, are selected from Q23, P25, G45, N57, P59, K65, R72, D76, R78, N81, D110, F130, L149, P150, Q151, G152, S156, P157, Y183, D185, D186, G384, D443, Q475, E478, A481, A485, D498, and S499 of SEQ ID NO:37.

In another particular embodiment, residues of the reverse transcriptase, mutation of which affects the SIV reverse transcriptase activity in the polymerase domain, are preferably selected from D110, Y183, D185, and D186 (residues involved in the DNA polymerase catalytic centre also herein identified as hydrophobic dNTP binding pocket) from SEQ ID NO:37, and any combination thereof.

An example of a preferred mutation is a non-conservative substitution of the Aspartic acid (D) residue (encoded by the codon GA$\underline{T}$ or the codon GA$\underline{C}$) in position 110 by a Glutamic acid (E) residue (encoded by the codon GA$\underline{A}$ or the codon GA$\underline{G}$), i.e., a mutation D110E. Further preferred mutations of the SIV reverse transcriptase polymerase domain are herein exemplified (see Table 3).

In a further particular embodiment, residues of the reverse transcriptase, mutation of which affects the SIV reverse transcriptase activity in the RNAseH domain, are preferably selected from D443, E478, and D498 (residues involved in the RNAseH catalytic site) of SEQ ID NO:37, and any combination thereof.

An example of a preferred mutation is a non-conservative substitution of the Glutamic acid (E) residue (encoded by the codon $\underline{G}$AA or the codon $\underline{G}$AG) in position 478 by a Glutamine (Q) residue (encoded by the codon $\underline{C}$AA or the codon $\underline{C}$AG), also herein identified as mutation E478Q. Further preferred mutations of the SIV reverse transcriptase RNAseH domain are herein exemplified (see Table 3).

In another particular embodiment, the SIV reverse transcriptase contains a D110E substitution affecting its polymerase activity and an E478Q substitution affecting its RNAseH activity.

In another particular embodiment, a mutation affecting the SIV reverse transcriptase is a substitution of the Asparagine residue (N) in position 57 of SEQ ID NO:37 by a naturally occurring amino acid residue selected from A, C, D, E, F, G, H, I, K, L, M, P, Q, R, S, T, V, W and Y (SEQ ID N0:86). As an example, said N residue, encoded by the codon AAT or the codon AAC, is substituted by a Tryptophan (W) residue, encoded by the codon TGG; this particular mutation is also herein identified as mutation N57W.

In another particular embodiment, a mutation affecting the SIV reverse transcriptase is a substitution of the Glycine residue (G) in position 152 of SEQ ID NO:37 by a naturally occurring amino acid residue selected from A, C, D, E, F, H, I, K, L, M, N, P, Q, R, S, T, V, W and Y (SEQ ID NO:86). As an example, said G residue, encoded by a codon selected from GGT, GGC, GGA and GGG, is substituted by a Cysteine (C) residue, encoded by the codon TGT or the codon TGC; this particular mutation is also herein identified as mutation G152C.

In another particular embodiment, a mutation affecting the SIV reverse transcriptase is a substitution of the Glycine residue (G) in position 384 of SEQ ID NO:37 by a naturally occurring amino acid residue selected from A, C, D, E, F, H, I, K, L, M, N, P, Q, R, S, T, V, W and Y (SEQ ID NO:86). As an example, said G residue, encoded by a codon selected from GGT, GGC, GGA and GGG, is substituted by a Serine (S) residue, encoded by a codon selected from TCT, TCC, TCA, TCG, AGT and AGC; this particular mutation is also herein identified as mutation G384S.

In another particular embodiment, a mutation affecting the SIV reverse transcriptase is a substitution of the Alanine residue (A) in position 485 of SEQ ID NO:37 by a naturally occurring amino acid residue selected from C, D, E, F, G, H, I, K, L, M, N, P, Q, R, S, T, V, W and Y (SEQ ID NO:86). As an example, said A residue, encoded by a codon selected from GCT, GCC, GCA and GCG, is substituted by a Histidine (H) residue, encoded by the codon CAT or the codon CAC; this particular mutation is also herein identified as mutation A485H.

In a particular embodiment, the residues of the reverse transcriptase, mutation of which affects the HIV-2 reverse transcriptase activity in the polymerase domain and/or the RNAseH domain, are selected from Q23, P25, G45, N57, P59, K65, R72, D76, R78, N81, D110, F130, L149, P150, Q151, G152, S156, P157, Y183, D185, D186, G383, D442, Q474, E477, A480, A484, D497, and S498 of SEQ ID NO:38.

In another particular embodiment, residues of the reverse transcriptase, mutation of which affects the HIV-2 reverse transcriptase activity in the polymerase domain, are preferably selected from D110, Y183, D185, and D186 (residues involved in the DNA polymerase catalytic centre, also herein identified as the hydrophobic dNTP binding pocket) from SEQ ID NO:38, and any combination thereof.

An example of a preferred mutation is a non-conservative substitution of the Aspartic acid (D) residue (encoded by the codon GA$\underline{T}$ or the codon GA$\underline{C}$) in position 110 by a Glutamic acid (E) residue (encoded by the codon GA$\underline{A}$ or the codon GA$\underline{G}$), also herein identified as mutation D110E. Further preferred mutations of the HIV-2 reverse transcriptase polymerase domain are herein exemplified (see Table 3).

In a further particular embodiment, residues of the reverse transcriptase, mutation of which affects the HIV-2 reverse transcriptase activity in the RNAseH domain, are preferably selected from D442, E477, and D497 (residues involved in the RNAseH catalytic site) of SEQ ID NO:38, and any combination thereof.

An example of a preferred mutation is a non-conservative substitution of the Glutamic acid (E) residue (encoded by the codon $\underline{G}$AA or the codon $\underline{G}$AG) in position 477 by a Glutamine (Q) residue (encoded by the codon $\underline{C}$AA or the codon $\underline{C}$AG), also herein identified as mutation E477Q. Further preferred mutations of the HIV-2 reverse transcriptase RNAseH domain are herein exemplified (see Table 3).

In another particular embodiment, the HIV-2 reverse transcriptase contains a D110E substitution affecting its polymerase activity and an E477Q substitution affecting its RNAseH activity.

In another particular embodiment, a mutation affecting the HIV-2 reverse transcriptase is a substitution of the Asparagine residue (N) in position 57 of SEQ ID NO:38 by a naturally occurring amino acid residue selected from A, C, D, E, F, G, H, I, K, L, M, P, Q, R, S, T, V, W and Y (SEQ ID NO:87). As an example, said N residue, encoded by the codon AAT or the codon AAC, is substituted by a Tryptophan (W) residue, encoded by the codon TGG; this particular mutation is also herein identified as mutation N57W.

In another particular embodiment, a mutation affecting the HIV-2 reverse transcriptase is a substitution of the Glycine residue (G) in position 152 of SEQ ID NO: 38 by a naturally occurring amino acid residue selected from A, C, D, E, F, H, I, K, L, M, N, P, Q, R, S, T, V, W and Y (SEQ ID NO:87). As an example, said G residue, encoded by a codon selected from GGT, GGC, GGA and GGG, is substituted by a Cysteine (C) residue, encoded by the codon TGT or the codon TGC; this particular mutation is also herein identified as mutation G152C.

In another particular embodiment, a mutation affecting the HIV-2 reverse transcriptase is a substitution of the Glycine residue (G) in position 383 of SEQ ID NO: 38 by a naturally occurring amino acid residue selected from A, C, D, E, F, H, I, K, L, M, N, P, Q, R, S, T, V, W and Y (SEQ ID NO:87). As an example, said G residue, encoded by a codon selected from GGT, GGC, GGA and GGG, is substituted by a Serine (S) residue, encoded by a codon selected from TCT, TCC, TCA, TCG, AGT and AGC; this mutation is also herein identified as mutation G383S.

In another particular embodiment, a mutation affecting the HIV-2 reverse transcriptase is a substitution of the Alanine residue (A) in position 484 of SEQ ID NO: 38 by a naturally occurring amino acid residue selected from C, D, E, F, G, H, I, K, L, M, N, P, Q, R, S, T, V, W and Y (SEQ ID NO:87). As an example, said A residue, encoded by a codon selected from GCT, GCC, GCA and GCG, is substituted by a Histidine (H) residue, encoded by the codon CAT or the codon CAC; this particular mutation is also herein identified as mutation A484H.

In a particular embodiment, the residues of the reverse transcriptase, mutation of which affects the FIV reverse transcriptase activity in the polymerase domain and/or the RNAseH domain, are selected from Q25, P27, G47, N59, P61, K67, R73, D77, R79, N82, D111, F131, L150, P151, Q152, G153, S157, P158, Y184, D186, D187, G386, D447, Q477, E480, A483, A487, D500, and S501 of SEQ ID NO:39.

In another particular embodiment, residues of the reverse transcriptase, mutation of which affects the FIV reverse transcriptase activity in the polymerase domain, are preferably selected from D111, Y184, D186, and D187 (residues involved in the DNA polymerase catalytic centre, also herein identified as the hydrophobic dNTP binding pocket) from SEQ ID NO:39, and any combination thereof.

An example of a preferred mutation is a non-conservative substitution of the Aspartic acid (D) residue (encoded by the codon GAT or the codon GAC) in position 111 by a Glutamic acid (E) residue (encoded by the codon GAA or the codon GAG on the nucleic molecule), also herein identified as mutation D111E. Further preferred mutations of the FIV reverse transcriptase polymerase domain are herein exemplified (see Table 3).

In a further particular embodiment, residues of the reverse transcriptase, mutation of which affects the FIV reverse transcriptase activity in the RNAseH domain, are preferably selected from D447, E480, and D500 (residues involved in the RNAseH catalytic site) of SEQ ID NO:39, and any combination thereof.

An example of a preferred mutation is a non-conservative substitution of the Glutamic acid (E) residue (encoded by the codon GAA or the codon GAG) in position 480 by a Glutamine (Q) residue (encoded by the codon CAA or the codon CAG), also herein identified as mutation E480Q. Further preferred mutations of the FIV reverse transcriptase RNAseH domain are herein exemplified (see Table 3).

In another particular embodiment, a mutation affecting the FIV reverse transcriptase is a substitution of the Asparagine residue (N) in position 59 of SEQ ID NO:39 by a naturally occurring amino acid residue selected from A, C, D, E, F, G, H, I, K, L, M, P, Q, R, S, T, V, W and Y (SEQ ID N0:88). As an example, said N residue, encoded by the codon AAT the codon AAC, is substituted by a Tryptophan (W) residue, encoded by the codon TGG; this particular mutation is also herein identified as mutation N59W.

In another particular embodiment, a mutation affecting the FIV reverse transcriptase is a substitution of the Glycine residue (G) in position 153 of SEQ ID NO:39 by a naturally occurring amino acid residue selected from A, C, D, E, F, H, I, K, L, M, N, P, Q, R, S, T, V, W and Y (SEQ ID NO:88). As an example, said G residue, encoded by a codon selected from GGT, GGC, GGA and GGG, is substituted by a Cysteine (C) residue, encoded by the codon TGT or the codon TGC; this particular mutation is also herein identified as mutation G153C.

In another particular embodiment, a mutation affecting the FIV reverse transcriptase is a substitution of the Glycine residue (G) in position 386 of SEQ ID NO:39 by a naturally occurring amino acid residue selected from A, C, D, E, F, H, I, K, L, M, N, P, Q, R, S, T, V, W and Y (SEQ ID NO:88). As an example, said G residue, encoded by a codon selected from GGT, GGC, GGA and GGG, is substituted by a Serine (S) residue, encoded by a codon selected from TCT, TCC, TCA, TCG, AGT and AGC; this particular mutation is also herein identified as mutation G386S.

In another particular embodiment, a mutation affecting the FIV reverse transcriptase is a substitution of the Alanine residue (A) in position 487 of SEQ ID NO:39 by a naturally occurring amino acid residue selected from C, D, E, F, G, H, I, K, L, M, N, P, Q, R, S, T, V, W and Y (SEQ ID NO:88). As an example, said A residue, encoded by a codon selected from GCT, GCC, GCA and GCG, is substituted by a Histidine (H) residue, encoded by the codon CAT or the codon CAC; this particular mutation is also herein identified as mutation A487H.

In a particular embodiment, the residues of the reverse transcriptase, mutation of which affects the EIAV reverse transcriptase activity in the polymerase domain and/or the RNAseH domain, are selected from Q14, P16, G36, N48, P50, K56, R62, D66, R68, N71, D100, F120, L139, P140, Q141, G142, S146, P147, Y173, D175, D176, G372, D430, Q460, E463, A466, A470, D484, and S485 of SEQ ID NO: 40.

In another particular embodiment, residues of the reverse transcriptase, mutation of which affects the EIAV reverse transcriptase activity in the polymerase domain, are preferably selected from D100, Y173, D175, and D176 (residues involved in the DNA polymerase catalytic centre, also herein identified as the hydrophobic dNTP binding pocket) from SEQ ID NO: 40, and any combination thereof.

An example of a preferred mutation is a non-conservative substitution of the Aspartic acid (D) residue (encoded by the codon GAT or the codon GAC) in position 100 by a Glutamic acid (E) residue (encoded by the codon GAA or the codon GAG), also herein identified as mutation D100E. Further preferred mutations of the EIAV reverse transcriptase polymerase domain are herein exemplified (see Table 3).

In a further particular embodiment, residues of the reverse transcriptase, mutation of which affects the EIAV reverse transcriptase activity in the RNAseH domain, are preferably selected from residues D430, E463, and D484 (residues involved in the RNAseH catalytic site) of SEQ ID NO: 40, and any combination thereof.

An example of a preferred mutation is a non-conservative substitution of the Glutamic acid (E) residue (encoded by the codon GAA or the codon GAG) in position 463 by a Glutamine (Q) residue (encoded by the codon CAA or the codon CAG), also herein identified as mutation E463Q. Further preferred mutations of the EIAV reverse transcriptase RNAseH domain are herein exemplified (see Table 3).

In another particular embodiment, the EIAV reverse transcriptase contains a D100E substitution affecting its polymerase activity and an E463Q substitution affecting its RNAseH activity.

In another particular embodiment, a mutation affecting the EIAV reverse transcriptase is a substitution of the Asparagine residue (N) in position 48 of SEQ ID NO:40 by a naturally occurring amino acid residue selected from A, C, D, E, F, G, H, I, K, L, M, P, Q, R, S, T, V, W and Y (SEQ ID N0:89). As an example, said N residue, encoded by the codon AAT or the codon AAC, is substituted by a Tryptophan (W) residue, encoded by the codon TGG; this particular mutation is also herein identified as mutation N48W.

In another particular embodiment, a mutation affecting the EIAV reverse transcriptase is a substitution of the Glycine residue (G) in position 142 of SEQ ID NO: 40 by a naturally occurring amino acid residue selected from A, C, D, E, F, H, I, K, L, M, N, P, Q, R, S, T, V, W and Y (SEQ ID NO:89). As an example, said G residue, encoded by a codon selected from GGT, GGC, GGA and GGG, is substituted by a Cysteine (C) residue, encoded by the codon TGT or the codon TGC; this particular mutation is also herein identified as mutation G142C.

In another particular embodiment, a mutation affecting the EIAV reverse transcriptase is a substitution of the Glycine residue (G) in position 372 of SEQ ID NO: 40 by a naturally occurring amino acid residue selected from A, C, D, E, F, H, I, K, L, M, N, P, Q, R, S, T, V, W and Y (SEQ ID NO:89). As an example, said G residue, encoded by a codon selected from GGT, GGC, GGA and GGG, is substituted by a Serine (S) residue, encoded by a codon selected from TCT, TCC, TCA, TCG, AGT and AGC; this particular mutation is also herein identified as mutation G372S.

In another particular embodiment, a mutation affecting the EIAV reverse transcriptase is a substitution of the Alanine residue (A) in position 470 of SEQ ID NO: 40 by a naturally occurring amino acid residue selected from C, D, E, F, G, H, I, K, L, M, N, P, Q, R, S, T, V, W and Y (SEQ ID NO:89). As an example, said A residue, encoded by a codon selected from GCT, GCC, GCA and GCG, is substituted by a Histidine (H) residue, encoded by the codon CAT or the codon CAC; this particular mutation is also herein identified as mutation A470H.

In a particular embodiment, the residues of the reverse transcriptase, mutation of which affects the CAEV reverse transcriptase activity in the polymerase domain and/or the RNAseH domain, are selected from Q18, P20, G40, N52, P54, K60, R66, D70, R72, N75, D104, F124, L143, P144, Q145, G146, S150, P151, Y177, D179, D180, G375, D432, Q461, E464, A467, A471, D484, and S485 of SEQ ID NO: 41.

In another particular embodiment, residues of the reverse transcriptase, mutation of which affects the CAEV reverse transcriptase activity in the polymerase domain, are preferably selected from as D104, Y177, D179, and D180 (residues involved in the DNA polymerase catalytic centre, also herein identified as the hydrophobic dNTP binding pocket) from SEQ ID NO: 41, and any combination thereof.

An example of a preferred mutation is a non-conservative substitution of the Aspartic acid (D) residue (encoded by the codon GAT or the codon GAC) in position 104 by a Glutamic acid (E) residue (encoded by the codon GAA or the codon GAG), also herein identified as mutation D104E. Further preferred mutations of the CAEV reverse transcriptase polymerase domain are herein exemplified (see Table 3).

In a further particular embodiment, residues of the reverse transcriptase, mutation of which affects the CAEV reverse transcriptase activity in the RNAseH domain, are preferably selected from D432, E464, and D484 (residues involved in the RNAseH catalytic site) of SEQ ID NO: 41, and any combination thereof.

An example of a preferred mutation is a non-conservative substitution of the Glutamic acid (E) residue (encoded by the codon GAA or the codon) in position 464 by a Glutamine (Q) residue (encoded by the codon CAA or the codon CAG), also herein identified as mutation E464Q. Further preferred mutations of the CAEV reverse transcriptase RNAseH domain are herein exemplified (see Table 3).

In another particular embodiment, the CAEV reverse transcriptase contains a D104E substitution affecting its polymerase activity and an E464Q substitution affecting its RNAseH activity.

In another particular embodiment, a mutation affecting the CAEV reverse transcriptase is a substitution of the Asparagine residue (N) in position 52 of SEQ ID NO:41 by a naturally occurring amino acid residue selected from A, C, D, E, F, G, H, I, K, L, M, P, Q, R, S, T, V, W and Y (SEQ ID NO: 90). As an example, said N residue, encoded by the codon AAT or the codon AAC, is substituted by a Tryptophan (W) residue, encoded by the codon TGG; this particular mutation is also herein identified as mutation N52W.

In another particular embodiment, a mutation affecting the CAEV reverse transcriptase is a substitution of the Glycine residue (G) in position 146 of SEQ ID NO: 41 by a naturally occurring amino acid residue selected from A, C, D, E, F, H, I, K, L, M, N, P, Q, R, S, T, V, W and Y (SEQ ID NO: 90). As an example, said G residue, encoded by a codon selected from GGT, GGC, GGA and GGG, is substituted by a Cysteine (C) residue, encoded by the codon TGT or the codon TGC; this particular mutation is also herein identified as mutation G146C.

In another particular embodiment, a mutation affecting the CAEV reverse transcriptase is a substitution of the Glycine residue (G) in position 375 of SEQ ID NO: 41 by a naturally occurring amino acid residue selected from A, C, D, E, F, H, I, K, L, M, N, P, Q, R, S, T, V, W and Y(SEQ ID NO: 90). As an example, said G residue, encoded by a codon selected from GGT, GGC, GGA and GGG, is substituted by a Serine (S) residue, encoded by a codon selected from TCT, TCC, TCA, TCG, AGT and AGC; this particular mutation is also herein identified as mutation G375S.

In another particular embodiment, a mutation affecting the CAEV reverse transcriptase is a substitution of the Alanine residue (A) in position 471 of SEQ ID NO: 41 by a naturally occurring amino acid residue selected from C, D, E, F, G, H, I, K, L, M, N, P, Q, R, S, T, V, W and Y (SEQ ID NO: 90). As an example, said A residue, encoded by a codon selected from GCT, GCC, GCA and GCG, is substituted by a Histidine (H) residue, encoded by the codon CAT or the codon CAC; this particular mutation is also herein identified as mutation A471H.

In a particular embodiment, the residues of the reverse transcriptase, mutation of which affects the Visna virus reverse transcriptase activity in the polymerase domain and/or the RNAseH domain, are selected from Q26, P28, G48, N60, P62, K68, R74, D78, R80, N83, D112, F132, L151, P152, Q153, G154, S158, P159, Y185, D187, D188, G383, D440, Q469, E472, A475, A479, D492, and S493 of SEQ ID NO: 42.

In another particular embodiment, residues of the reverse transcriptase, mutation of which affects the Visna virus reverse transcriptase activity in the polymerase domain, are preferably selected from D112, Y185, D187, and D188 (residues involved in the DNA polymerase catalytic centre, also herein identified as the hydrophobic dNTP binding pocket) from SEQ ID NO: 42, and any combination thereof.

An example of a preferred mutation is a non-conservative substitution of the Aspartic acid (D) residue (encoded by the codon GA<u>T</u> or the codon GA<u>C</u>) in position 112 by a Glutamic acid (E) residue (encoded by the codon GA<u>A</u> or the codon GA<u>G</u>), also herein identified as mutation D112E. Further preferred mutations of the Visna virus reverse transcriptase polymerase domain are herein exemplified (see Table 3).

In a further particular embodiment, residues of the reverse transcriptase, mutation of which affects the Visna virus reverse transcriptase activity in the RNAseH domain, are preferably selected from D440, E472, and D492 (residues involved in the RNAseH catalytic site) of SEQ ID NO: 42, and any combination thereof.

An example of preferred mutation is a non-conservative substitution of the Glutamic acid (E) residue (encoded by the codon <u>G</u>AA or the codon <u>G</u>AG) in position 472 by a Glutamine (Q) residue (encoded by the codon <u>C</u>AA or the codon <u>C</u>AG), also herein identified as mutation E472Q. Further preferred mutations of the Visna virus reverse transcriptase RNAseH domain are herein exemplified (see Table 3).

In another particular embodiment, the Visna virus reverse transcriptase contains a D112E substitution affecting its polymerase activity and an E472Q substitution affecting its RNAseH activity.

In another particular embodiment, a mutation affecting the Visna virus reverse transcriptase is a substitution of the Asparagine residue (N) in position 60 of SEQ ID NO:42 by a naturally occurring amino acid residue selected from A, C, D, E, F, G, H, I, K, L, M, P, Q, R, S, T, V, W and Y (SEQ ID NO: 91). As an example, said N residue, encoded by the codon AAT or the codon AAC, is substituted by a Tryptophan (W) residue, encoded by the codon TGG; this particular mutation is also herein identified as mutation N60W.

In another particular embodiment, a mutation affecting the Visna virus reverse transcriptase is a substitution of the Glycine residue (G) in position 154 of SEQ ID NO:42 by a naturally occurring amino acid residue selected from A, C, D, E, F, H, I, K, L, M, N, P, Q, R, S, T, V, W and Y (SEQ ID NO: 91). As an example, said G residue, encoded by a codon selected from GGT, GGC, GGA and GGG, is substituted by a Cysteine (C) residue, encoded by the codon TGT or the codon TGC; this particular mutation is also herein identified as mutation G154C.

In another particular embodiment, a mutation affecting the Visna virus reverse transcriptase is a substitution of the Glycine residue (G) in position 383 of SEQ ID NO:42 by a naturally occurring amino acid residue selected from A, C, D, E, F, H, I, K, L, M, N, P, Q, R, S, T, V, W and Y (SEQ ID NO: 91). As an example, said G residue, encoded by a codon selected from GGT, GGC, GGA and GGG, is substituted by a Serine (S) residue, encoded by a codon selected from TCT, TCC, TCA, TCG, AGT and AGC; this particular mutation is also herein identified as mutation G383S.

In another particular embodiment, a mutation affecting the Visna virus reverse transcriptase is a substitution of the Alanine residue (A) in position 479 of SEQ ID NO:42 by a naturally occurring amino acid residue selected from C, D, E, F, G, H, I, K, L, M, N, P, Q, R, S, T, V, W and Y (SEQ ID NO: 91). As an example, said A residue, encoded by a codon selected from GCT, GCC, GCA and GCG, is substituted by a Histidine (H) residue, encoded by the codon CAT or the codon CAC; this particular mutation is also herein identified as mutation A479H.

In a particular embodiment, the residues of the reverse transcriptase, mutation of which affects the BIV reverse transcriptase activity in the polymerase domain and/or the RNAseH domain, are selected from Q36, P38, G58, N70, P72, K78, R85, D89, R91, N94, D123, F143, L162, P163, Q164, G165, S169, P170, Y196, D198, D199, G390, D446, Q474, E477, A480, A484, D497, and S498 of SEQ ID NO: 43.

In another particular embodiment, residues of the reverse transcriptase, mutation of which affects the BIV reverse transcriptase activity in the polymerase domain, are preferably selected from D123, Y196, D198, and D199 (residues involved in the DNA polymerase catalytic centre, also herein identified as the hydrophobic dNTP binding pocket) from SEQ ID NO: 43, and any combination thereof.

An example of preferred mutation is a non-conservative substitution of the Aspartic acid (D) residue (encoded by the codon GA<u>T</u> or the codon GA<u>C</u>) in position 123 by a Glutamic acid (E) residue (encoded by the codon GA<u>A</u> or the codon GA<u>G</u>), also herein identified as mutation D123E. Further preferred mutations of the BIV reverse transcriptase polymerase domain are herein exemplified (see Tables 3 and 4).

In a further particular embodiment, residues of the reverse transcriptase, mutation of which affects the BIV reverse transcriptase activity in the RNAseH domain, are preferably selected from D446, E477, and D497 (residues involved in the RNAseH catalytic site) of SEQ ID NO: 43, and any combination thereof.

An example of preferred mutation is a non-conservative substitution of the Glutamic acid (E) residue (encoded by the codon <u>G</u>AA or the codon <u>G</u>AG) in position 477 by a Glutamine residue, (Q, encoded by the codon <u>C</u>AA or the codon <u>C</u>AG), also herein identified as mutation E477Q. Further preferred mutations of the BIV reverse transcriptase RNAseH domain are herein exemplified (see Table 3).

In another particular embodiment, the BIV reverse transcriptase contains a D123E substitution affecting its polymerase activity and an E477Q substitution affecting its RNAseH activity.

In another particular embodiment, a mutation affecting the BIV reverse transcriptase is a substitution of the Asparagine residue (N) in position 70 of SEQ ID NO:43 by a naturally occurring amino acid residue selected from A, C, D, E, F, G, H, I, K, L, M, P, Q, R, S, T, V, W and Y (SEQ ID NO: 92). As an example, said N residue, encoded by the codon AAT or the codon AAC, is substituted by a Tryptophan (W) residue, encoded by the codon TGG; this particular mutation is also herein identified as mutation N70W.

In another particular embodiment, a mutation affecting the BIV reverse transcriptase is a substitution of the Glycine residue (G) in position 165 of SEQ ID NO:43 by a naturally occurring amino acid residue selected from A, C, D, E, F, H, I, K, L, M, N, P, Q, R, S, T, V, W and Y (SEQ ID NO: 92).

As an example, said G residue, encoded by a codon selected from GGT, GGC, GGA and GGG, is substituted by a Cysteine (C) residue, encoded by the codon TGT or the codon TGC; this particular mutation is also herein identified as mutation G165C.

In another particular embodiment, a mutation affecting the BIV reverse transcriptase is a substitution of the Glycine residue (G) in position 390 of SEQ ID NO:43 by a naturally occurring amino acid residue selected from A, C, D, E, F, H, I, K, L, M, N, P, Q, R, S, T, V, W and Y (SEQ ID NO: 92). As an example, said G residue, encoded by a codon selected from GGT, GGC, GGA and GGG, is substituted by a Serine (S) residue, encoded by a codon selected from TCT, TCC, TCA, TCG, AGT and AGC; this particular mutation is also herein identified as mutation G390S.

In another particular embodiment, a mutation affecting the BIV reverse transcriptase is a substitution of the Alanine residue (A) in position 484 of SEQ ID NO:43 by a naturally occurring amino acid residue selected from C, D, E, F, G, H, I, K, L, M, N, P, Q, R, S, T, V, W and Y (SEQ ID NO: 92). As an example, said A residue, encoded by a codon selected from GCT, GCC, GCA and GCG, is substituted by a Histidine (H) residue, encoded by the codon CAT or the codon CAC; this particular mutation is also herein identified as mutation A484H.

In a particular embodiment, the residues of the reverse transcriptase, mutation of which affects the ALV reverse transcriptase activity in the polymerase domain and/or the RNAseH domain, are selected Q23, P25, G45, N55, P57, K63, R69, D73, R75, N78, D107, F127, L146, P147, Q148, G149, S153, P154, Y180, D182, D183, G381, D450, Q481, E484, A487, A491, D505, and S506 of SEQ ID NO: 44.

In another particular embodiment, residues of the reverse transcriptase, mutation of which affects the ALV reverse transcriptase activity in the polymerase domain, are preferably selected from D107, Y180, D182, and D183 (residues involved in the DNA polymerase catalytic centre, also herein identified as the hydrophobic dNTP binding pocket) from SEQ ID NO: 44, and any combination thereof.

An example of preferred mutation is a non-conservative substitution of the Aspartic acid (D) residue (encoded by the codon GA<u>T</u> or the codon GA<u>C</u>) in position 107 by a Glutamic acid (E) residue (encoded by the codon GA<u>A</u> or the codon GA<u>G</u>), also herein identified as mutation D107E. Further preferred mutations of the ALV reverse transcriptase polymerase domain are herein exemplified (see Tables 3 and 4).

In a further particular embodiment, residues of the reverse transcriptase, mutation of which affects the ALV reverse transcriptase activity in the RNAseH domain, are preferably selected from D450, E484, and D505 (residues involved in the RNAseH catalytic site) of SEQ ID NO: 44., and any combination thereof.

An example of preferred mutation is a non-conservative substitution of the Glutamic acid (E) residue (encoded by the codon <u>G</u>AA or the codon <u>G</u>AG) in position 484 by a Glutamine (Q) residue (encoded by the codon <u>C</u>AA or the codon <u>C</u>AG), also herein identified as mutation E484Q. Further preferred mutations of the ALV reverse transcriptase RNAseH domain are herein exemplified (see Tables 3 and 4).

In another particular embodiment, the ALV reverse transcriptase contains a D107E substitution affecting its polymerase activity and an E484Q substitution affecting its RNAseH activity.

In another particular embodiment, a mutation affecting the ALV reverse transcriptase is a substitution of the Asparagine residue (N) in position 55 of SEQ ID NO:44 by a naturally occurring amino acid residue selected from A, C, D, E, F, G, H, I, K, L, M, P, Q, R, S, T, V, W and Y (SEQ ID NO: 93). As an example, said N residue, encoded by the codon AAT or the codon AAC, is substituted by a Tryptophan (W) residue, encoded by the codon TGG; this particular mutation is also herein identified as mutation N55W.

In another particular embodiment, a mutation affecting the ALV reverse transcriptase is a substitution of the Glycine residue (G) in position 149 of SEQ ID NO:44 by a naturally occurring amino acid residue selected from A, C, D, E, F, H, I, K, L, M, N, P, Q, R, S, T, V, W and Y (SEQ ID NO: 93). As an example, said G residue, encoded by a codon selected from GGT, GGC, GGA and GGG, is substituted by a Cysteine (C) residue, encoded by the codon TGT or the codon TGC; this particular mutation is also herein identified as mutation G149C.

In another particular embodiment, a mutation affecting the ALV reverse transcriptase is a substitution of the Glycine residue (G) in position 381 of SEQ ID NO:44 by a naturally occurring amino acid residue selected from A, C, D, E, F, H, I, K, L, M, N, P, Q, R, S, T, V, W and Y (SEQ ID NO: 93). As an example, said G residue, encoded by a codon selected from GGT, GGC, GGA and GGG, is substituted by a Serine (S) residue, encoded by a codon selected from TCT, TCC, TCA, TCG, AGT and AGC; this particular mutation is also herein identified as mutation G381S.

In another particular embodiment, a mutation affecting the ALV reverse transcriptase is a substitution of the Alanine residue (A) in position 491 of SEQ ID NO:44 by a naturally occurring amino acid residue selected from C, D, E, F, G, H, K, M, N, P, Q, R, W and Y (SEQ ID NO: 93). As an example, said A residue, encoded by a codon selected from GCT, GCC, GCA and GCG, is substituted by a Histidine (H) residue, encoded by a codon selected from CAT and CAC; this particular mutation is also herein identified as mutation A491H.

In a particular embodiment, the residues of the reverse transcriptase, mutation of which affects the HFV reverse transcriptase activity in the polymerase domain and/or the RNAseH domain, are selected from Q167, P169, G189, N199, P201, K207, R213, D217, R219, N222, D252, F272, L284, P285, Q286, G287, S291, P292, Y312, D314, D315, G519, D599, Q643, E646, A649, A653, D669, and S670 of SEQ ID NO: 45.

In another particular embodiment, residues of the reverse transcriptase, mutation of which affects the HFV reverse transcriptase activity in the polymerase domain, are preferably selected from D252, Y312, D314, and D315 (residues involved in the DNA polymerase catalytic centre, also herein identified as the hydrophobic dNTP binding pocket) from SEQ ID NO: 45, and any combination thereof.

An example of preferred mutation is a non-conservative substitution of the Aspartic acid (D) residue (encoded by the codon GA<u>T</u> and GA<u>C</u>) in position 252 by a Glutamic acid (E) residue (encoded by the codon GA<u>A</u> or the codon GA<u>G</u>), also herein identified as mutation D252E. Further preferred mutations of the HFV reverse transcriptase polymerase domain are herein exemplified (see Tables 3 and 4).

In a further particular embodiment, residues of the reverse transcriptase, mutation of which affects the HFV reverse transcriptase activity in the RNAseH domain, are preferably selected from D599, E646, and D669 (residues involved in the RNAseH catalytic site) of SEQ ID NO: 45, and any combination thereof.

An example of preferred mutation is a non-conservative substitution of the Glutamic acid (E) residue (encoded by the codon GAA or the codon GAG) in position 646 by a Glutamine (Q) residue (encoded by the codon CAA or the codon CAG), also herein identified as mutation E646Q. Further preferred mutations of the HFV reverse transcriptase RNAseH domain are herein exemplified (see Tables 3 and 4).

In another particular embodiment, the HFV reverse transcriptase contains a D252E substitution affecting its polymerase activity and an E646Q substitution affecting its RNAseH activity.

In another particular embodiment, a mutation affecting the HFV reverse transcriptase is a substitution of the Asparagine residue (N) in position 199 of SEQ ID NO:45 by a naturally occurring amino acid residue selected from A, C, D, E, F, G, H, I, K, L, M, P, Q, R, S, T, V, W and Y (SEQ ID NO: 94). As an example, said N residue, encoded by the codon AAT or the codon AAC, is substituted by a Tryptophan (W) residue, encoded by the codon TGG; this particular mutation is also herein identified as mutation N199W.

In another particular embodiment, a mutation affecting the HFV reverse transcriptase is a substitution of the Glycine residue (G) in position 287 of SEQ ID NO:45 by a naturally occurring amino acid residue selected from A, C, D, E, F, H, I, K, L, M, N, P, Q, R, S, T, V, W and Y (SEQ ID NO: 94). As an example, said G residue, encoded by a codon selected from GGT, GGC, GGA and GGG, is substituted by a Cysteine (C) residue, encoded by the codon TGT or the codon TGC; this particular mutation is also herein identified as mutation G287C.

In another particular embodiment, a mutation affecting the HFV reverse transcriptase is a substitution of the Glycine residue (G) in position 519 of SEQ ID NO:45 by a naturally occurring amino acid residue selected from A, C, D, E, F, H, I, K, L, M, N, P, Q, R, S, T, V, W and Y (SEQ ID NO: 94). As an example, said G residue, encoded by a codon selected from GGT, GGC, GGA and GGG, is substituted by a Serine (S) residue, encoded by a codon selected from TCT, TCC, TCA, TCG, AGT and AGC; this particular mutation is also herein identified as mutation G519S.

In another particular embodiment, a mutation affecting the HFV reverse transcriptase is a substitution of the Alanine residue (A) in position 653 of SEQ ID NO:45 by a naturally occurring amino acid residue selected from C, D, E, F, G, H, I, K, L, M, N, P, Q, R, S, T, V, W and Y (SEQ ID NO: 94). As an example, said A residue, encoded by a codon selected from GCT, GCC, GCA and GCG, is substituted by a Histidine (H) residue, encoded by the codon CAT or the codon CAC; this particular mutation is also herein identified as mutation A653H.

In a further preferred embodiment, the vector of the invention, whether derived from an oncoretrovirus, a lentivirus or a spumavirus, comprises a reverse transcriptase containing a mutation affecting the YXDD motif of the DNA polymerase domain, corresponding for example to positions $^{183}$YXDD for HIV-1 reverse transcriptase (SEQ ID NO:1), to positions $^{222}$YXDD for MLV reverse transcriptase (SEQ ID NO:36), to positions $^{183}$YXDD for SIV reverse transcriptase (SEQ ID NO:37), to positions $^{183}$YXDD for HIV-2 reverse transcriptase (SEQ ID NO:38), to positions $^{184}$YXDD for FIV reverse transcriptase (SEQ ID NO:39), to positions $^{173}$YXDD for EIAV reverse transcriptase (SEQ ID NO:40), to positions $^{177}$YXDD for CAEV reverse transcriptase (SEQ ID NO:41), to positions $^{185}$YXDD for Visna virus reverse transcriptase (SEQ ID NO:42), to positions $^{196}$YXDD for BIV reverse transcriptase (SEQ ID NO:43), to positions $^{180}$YXDD for ALV reverse transcriptase (SEQ ID NO:44) and to positions $^{312}$YXDD for HFV reverse transcriptase (SEQ ID NO:45).

In another embodiment, the recombinant vector genome herein described can further comprise at least one sequence favouring or enhancing the transgene expression, in particular a post-transcriptional regulatory sequence and/or a sequence modifying the stability of mRNAs, for example selected from an intron (natural or synthetic), WPRE, APP 5'UTR, TAU 3'UTR, at least one copy of an miRNA target sequence and any combinations thereof, preferably chosen from WPRE, APP 5'UTR, TAU 3'UTR, and at least one copy of an miRNA target sequence (for example miRNA target sequence of mir 142-3p), even more preferably from two to twelve copies of an miRNA target sequences, typically at least four copies.

In another embodiment, the recombinant vector genome herein described can further comprise other regulatory sequences or elements, for example selected from an insulator (MAR, SAR, scs, scs', LCR, etc.), an IRES, a KOZAK or Shine-Dalgarno sequence, and a lentiviral central sequence (cPPT-CTS).

When the vector of the invention contains more than one transgene, said transgenes can be linked directly through a fusion construct preferentially including a 2A protease cleavage site, for example originating from the foot-and-mouth disease virus, or alternatively through an IRES sequence.

Transgenes advantageously usable in the context of the present invention can be selected from a catalytic nucleic acid, an aptamer, an miRNA, a decoy RNA, a nucleic acid encoding a biologically active peptide, for example an enzyme, a transcription factor, a growth factor, a trophic factor, a hormone, a cytokine, an antibody, a receptor, a differentiation factor, a colony stimulation factor, a suicide protein, a cell-cycle modifying protein, an anti-proliferative protein, a nuclease, a recombinase, a transposase, and a neurotransmitter or a precursor thereof.

In the context of the invention, when the transgene is a coding sequence, it is expressed from direct translation of the retroviral RNA vector genome. Expression of the transgene does not involve formation of a DNA intermediate, transcription of said DNA intermediate and translation of the de novo produced mRNA molecule.

In the context of the invention, the expression is necessarily transient, as it exclusively relies on RNA molecules. The duration of the transgene expression may be increased by increasing the stability of said RNA molecules, which are normally rapidly degraded by host cell nucleases. Increasing the stability of mRNA molecules includes methods known by skilled persons, such as addition of WPRE sequence.

The present invention further includes any composition comprising a vector as herein described, typically a pharmaceutical composition comprising such a vector together with a pharmaceutically acceptable excipient.

Pharmaceutically acceptable excipients or carriers are well-known in the art and include but are not limited to saline, buffered saline, dextrose, water, glycerol, sterile isotonic aqueous buffer, and combinations thereof. One example of such an acceptable carrier is a physiologically balanced culture medium containing one or more stabilizing agents such as stabilized, hydrolyzed proteins, lactose, etc. The carrier is preferably sterile. The formulation will be easily selected by the skilled person depending on the chosen mode of administration. Examples of administration methods are further described below.

The retroviral vectors of the present invention may be administered by injection, for example by intravenous or subcutaneous injection. The pharmaceutical forms suitable for injectable use include sterile aqueous solutions or dispersions and sterile powders for the extemporaneous preparation of sterile injectable solutions or dispersions. In all cases, the form must be sterile and must be fluid to the extent that easy syringability exists. It must be stable under the conditions of manufacture and storage and must be preserved against the contaminating action of microorganisms, such as bacteria and fungi. The carrier can be a solvent or dispersion medium containing, for example, water, ethanol, polyol (e.g., glycerol, propylene glycol, and liquid polyethylene glycol), suitable mixtures thereof, and vegetable oils.

The retroviral vectors of the present invention may also be administered directly to the airways in the form of an aerosol. For use as aerosols, the agents of the present invention in solution or suspension may be packaged in a pressurized aerosol container together with suitable propellants, for example, hydrocarbon propellants like propane, butane, or isobutane with conventional adjuvants. The materials of the present invention also may be administered in a non-pressurized form such as in a nebulizer or atomizer.

Suitable subjects to be treated with a retroviral vector of the present invention are those requiring the transient delivery of a particular RNA, said RNA being incorporated in the retroviral vector genome as a transgene. Such subjects include human and non-human animals, preferably mammals or avian species. Exemplary mammalian subjects include, without limitation, humans, non-human primates, dogs, cats, rodents, cattle, horses, sheep, and pigs. Exemplary avian subjects include, without limitation, chicken, quail, turkey, duck and goose.

The present invention further provides methods for preparing, in vitro or ex vivo, typically in vitro, a retroviral vector of the invention, which cannot on its own achieve complete reverse transcription.

An example of such a method typically comprises expressing within a cell:
  a. a transcomplementation capsid cassette, optionally split into several cassettes, comprising sequences derived from a retroviral genome encoding a retroviral gag sequence, said transcomplementation capsid cassette lacking any functional psi encapsidation signal, wherein said transcomplementation capsid cassette comprises a retroviral pol sequence encoding a reverse transcriptase which is non-functional for complete reverse transcription,
  b. a transcomplementation envelope cassette encoding for an envelope glycoprotein, and
  c. a vector cassette encoding for a retroviral recombinant ribonucleic vector genome comprising a 5' LTR retroviral sequence and a 3' LTR retroviral sequence flanking a retroviral psi encapsidation sequence, at least one transgene and possibly at least one post-transcriptional regulatory sequence, and recovery of the retroviral vectors produced.

The term "cassette" or "expression cassette" in the context of the present invention is to be understood as a nucleic acid sequence possibly involved in the production of one or several RNAs and/or one or several peptides or polypeptides. The cassette or expression cassette consists of possibly transcribed sequences, for instance but not limited to a gene or a combination of genes, which are possibly associated with functional transcription element(s), namely "promoter(s)"; it possibly contains additional sequences such as leader and trailer sequences, introns and sequences involved in the regulation or modulation of transcription such as inhibitors, enhancers, stabilizers, and internal ribosomal entry sites (IRES). The cassette or expression cassette can typically be transferred into target cells, for example as part of a plasmid, an artificial chromosome, a viral vector genome (for example a baculoviral or adenoviral vector genome), or a transposon. This cassette is then possibly expressed in the target cells.

When the cassette or expression cassette is a DNA molecule or part of a DNA molecule, "expression" is understood as transcription, i.e., production of a polyadenylated messenger RNA and in the case of a coding mRNA, its potential subsequent translation and production of a peptide. As an example, transgene expression in the context of a non-integrative retroviral vector occurs from the double-stranded DNA molecule generated through reverse transcription: the reverse transcribed genome is first transcribed and then translated.

When the cassette is an RNA molecule or part of an RNA molecule, "expression" refers to the mRNA translation into a peptide. As an example, transgene expression in the context of the invention occurs in the target cell through direct translation of the retroviral RNA vector genome.

Alternatively, when the cassette contains a non-coding RNA (for example a decoy RNA, miRNA, ribozyme, etc.), "expression" refers to delivery of the RNA into the target cell and its subsequent processing as a catalytic, decoy or interfering RNA.

"Transcomplementation proteins" or "transcomplementation peptides", in the context of the invention, are defined as proteins or peptides that are intended to be part of a retroviral vector particle as a protein but not as nucleic information (coding sequence) and that are expressed in trans within a "producer cell". Transcomplementation proteins or peptides for example typically include retroviral structural proteins (capsid, nucleocapsid, matrix) encoded by the gag gene, retroviral enzymes encoded by the pol gene (protease, reverse transcriptase, integrase), accessory or regulatory peptides (such as tat, rev and net) and an envelope glycoprotein encoded by the env gene.

The glycoprotein can be of retroviral origin, can be derived from a non-retroviral enveloped virus or from a cellular glycoprotein or can be a synthetic glycoprotein (such as a chimeric glycoprotein).

Genes encoding the transcomplementation proteins or peptides, namely the "transcomplementation cassettes" (for example the "transcomplementation envelope cassette" or the "transcomplementation capsid cassette"), are present transiently or constitutively (i.e., a transformed cell containing an integrated transcomplementation cassette) and expressed in a constitutive or regulated (for example inducible) manner, in the "producer cells", to produce retroviral vectors, typically using a plasmid, an artificial chromosome, a viral vector genome (for example a baculoviral or adenoviral vector genome), a transposon, or any combination thereof. As an example, plasmids used in the invention to bring the transcomplementation cassettes are also herein identified as "transcomplementation plasmids", for example the "transcomplementation envelope plasmid" or the "transcomplementation capsid plasmid". Retroviral transcomplementation proteins are derived from a single retrovirus or from a combination of different retroviruses, either oncoretroviruses, lentiviruses, or spumaviruses. Expression of the transcomplementation cassettes in producer cells along with the retroviral vector cassette leads to the production of the retroviral vector particles.

In the context of the invention, the transcomplementation capsid cassette may include a modified pol gene; however, said modification does not prevent capsid formation and encapsidation of the RNA vector genome in said capsid.

The "retroviral genome", in the context of the invention, refers to a nucleic acid sequence which is possibly encapsidated into a retroviral particle, for example (i) when present as a ribonucleic molecule in a "retroviral particle", or (ii) when present as a ribonucleic molecule in a cell infected by a "retrovirus" and undergoing retroviral replication.

The "retroviral vector genome", also herein identified as "vector genome" in the context of the invention refers to a nucleic acid sequence which is possibly encapsidated into a retroviral vector particle, for example (i) when present in producer cells as a ribonucleic molecule, or when present in the "retroviral vector particle" or (ii) when present as a ribonucleic molecule in a cell transduced by a "retroviral vector". In the context of the invention, the "retroviral vector genome" contains all the cis- and trans-active elements necessary for its proper production and encapsidation, including but not limited to the long terminal repeats (LTR) and the psi encapsidation signal. It also contains one or several cassette(s) encoding the gene of interest or transgene, said cassette possibly containing, as understood in the present invention, any element involved in the transcriptional or post-transcriptional regulation of the coding sequence.

Preferably, the recombinant retroviral vector genome is devoid of the gag, pol and/or env gene, even more preferably of the gag, pol and env genes. At least one of the gag, pol and env genes, as well as any fragments thereof, can intentionally be reintroduced into the vector genome as a "transgene", for example in the context of vaccination. Typically, the gag gene may be reintroduced.

The "vector cassette", in the context of the invention, allows the expression of a "vector genome" that will be encapsidated in the vector particles in "producer cells". The "vector cassette", in the context of the invention, is present transiently or constitutively (i.e., a transformed cell containing an integrated transcomplementation cassette) and expressed in a constitutive or regulated (for example inducible) manner, in the "producer cells", to produce retroviral vector genomes, typically using a plasmid, an artificial chromosome, a viral vector genome (for example a baculoviral or adenoviral vector genome), a transposon, or any combination thereof. As an example, the plasmid used in the invention to bring the vector cassette is also herein identified as the "vector plasmid" or "transcomplementation vector plasmid".

"Producer cells", in the context of the invention, are cells transiently or constitutively containing transcomplementation cassettes, which when expressed lead to the production of transcomplementation peptides. Expression of said transcomplementation peptides along with a retroviral vector genome in producer cells allows the production of retroviral vector particles, containing generally two copies of the retroviral vector genome RNA; said retroviral vector particles can be collected in the cell culture medium and further used for in vitro, ex vivo and/or in vivo purposes. Transcomplementation cassettes and vector cassettes can be brought into the producer cells by any method known by skilled persons, including, but not limited to, plasmid transfection, artificial chromosome transfection, or viral vector transduction, for example using adenovirus-derived vectors, baculovirus-derived vectors, herpes simplex virus-derived vectors, or transposons. Transcomplementation cassettes and vector cassettes are stably or transiently introduced into the producer cells and are constitutively transcriptionally active or their transcription is dependent on activation of the promoter, for example by a doxycycline-dependent regulation system.

Another example of a method according to the invention comprises expressing within a cell:
 a. a transcomplementation capsid cassette, optionally split into several cassettes, comprising sequences derived from a retroviral genome encoding a retroviral gag sequence, said transcomplementation capsid cassette lacking any functional psi encapsidation signal, wherein said transcomplementation capsid cassette does not comprise a reverse transcriptase encoding sequence,
 b. a transcomplementation envelope cassette encoding for an envelope glycoprotein, and
 c. a vector cassette encoding for a retroviral recombinant ribonucleic vector genome comprising a 5' LTR retroviral sequence and a 3' LTR retroviral sequence flanking a retroviral psi encapsidation sequence, at least one transgene and possibly at least one post-transcriptional regulatory sequence, and recovery of the retroviral vectors produced.

In the previously described methods, the retroviral recombinant ribonucleic vector genome may further be partially or fully deleted of the wild-type retroviral PBS sequence or may comprise a mutated (i.e., functionally altered) PBS sequence.

In a particular embodiment, a method of the invention for preparing, in vitro or ex vivo, typically in vitro, a retroviral vector of the invention consists of transient transfection of cells, for example HEK 293T cells, with at least two transcomplementation plasmids as defined previously and one retroviral vector plasmid expressing the ribonucleic retroviral vector genome to be encapsidated (Nat. Biotechnol. 1997 September; 15(9):871-5. Multiply attenuated lentiviral vector achieves efficient gene delivery in vivo. Zufferey R, Nagy D, Mandel R J, Naldini L, Trono D. Cell. 2000 Apr. 14; 101(2):173-85. HIV-1 genome nuclear import is mediated by a central DNA flap. Zennou V, Petit C, Guetard D, Nerhbass U, Montagnier L, Charneau P.).

In another particular embodiment, a method of the invention for preparing, in vitro or ex vivo, typically in vitro, a retroviral vector of the invention consists of stably expressing all or part of the required transcomplementation peptides in a producer cell and further transiently or stably expressing the ribonucleic retroviral vector genome to be encapsidated, optionally with the other required transcomplementation proteins (J Virol. 1998 November; 72(11):8463-71. A third-generation lentivirus vector with a conditional packaging system. Dull T, Zufferey R, Kelly M, Mandel R J, Nguyen M, Trono D, Naldini L.; Mol. Ther. 2000 August; 2(2):170-6. A stable system for the high-titer production of multiply attenuated lentiviral vectors. Klages N, Zufferey R, Trono D).

Another object of the invention is a retroviral vector obtainable with a method as herein described.

Another object of the invention is a nucleic acid sequence comprising a transcomplementation capsid cassette, optionally split into several cassettes, comprising sequences derived from a retroviral genome encoding a retroviral gag sequence, said transcomplementation capsid cassette lacking any functional psi encapsidation signal, wherein said transcomplementation capsid cassette i) comprises a retroviral pol sequence encoding a reverse transcriptase which is non-functional for complete reverse transcription, or ii) does not comprise a reverse transcriptase encoding sequence, and optionally:

- a nucleic acid sequence comprising a transcomplementation envelope cassette encoding for an envelope glycoprotein, and/or
- a nucleic acid sequence comprising a vector cassette encoding for a retroviral recombinant ribonucleic vector genome comprising a 5' LTR retroviral sequence and a 3' LTR retroviral sequence flanking a retroviral psi encapsidation sequence, at least one transgene and possibly at least one post-transcriptional regulatory sequence.

The nucleic acid sequence can be selected for example from a linear nucleic acid sequence, a plasmid, an artificial chromosome, a viral vector genome (such as a genome derived from a baculovirus, an adenovirus or a herpes virus), and a transposon.

A further object of the invention is a cell or cell line comprising a nucleic acid sequence as herein described, in particular a cell or cell line containing a transcomplementation capsid cassette which does not express a retroviral reverse transcriptase, or a cell or cell line containing a transcomplementation capsid cassette expressing, in a stable or an inducible manner, a retroviral reverse transcriptase comprising a mutation as herein described, which induces a loss of polymerase and/or RNAseH functions of said reverse transcriptase.

Another object of the invention is a composition, for example a pharmaceutical composition, comprising a vector, a nucleic acid sequence, and/or a cell or a cell line as herein described, and optionally a pharmaceutically acceptable excipient.

Another object of the invention is a kit comprising a vector, a nucleic acid sequence, a cell or a cell line, and/or a composition as herein described, and preferably written instructions for using the kit.

Applications

Also encompassed by the present invention are any possible uses of a product as herein described (vector, nucleic acid sequence, cell, cell line, composition and kit of the invention) for transiently expressing at least one transgene in vitro, ex vivo or in vivo, in particular of a vector according to the present invention or of a composition comprising such a vector.

There are multiple applications for the transient transfer of nucleic acids, in particular in experimental (e.g., research) and therapeutic fields. Examples of such applications relate to the transfer of functional nucleic acids into target cells and to the transient expression of a protein of interest or transient delivery of a non-coding RNA.

Such a protein of interest may be selected from any protein usable in the context of genetic engineering, of differentiation, of dedifferentiation, of therapy and of research.

In a particular embodiment, the vectors of the invention can be used to transiently express a genetic engineering tool, typically a DNA-modifying enzyme. A "DNA-modifying enzyme" is a natural or synthetic peptide, generally an enzyme, (i) with a particular affinity for a DNA molecule or chromatin, possibly a sequence-dependent affinity, and (ii) capable of introducing modification in said DNA or chromatin by, for example, generating a double-stranded break in the target DNA molecule, removing a sequence from the target DNA molecule, introducing a sequence into the target DNA molecule, modifying the epigenetic imprinting of the target DNA or chromatin, modifying the tridimensional structure and/or ligating ends of one or several DNA molecules.

Such a DNA-modifying enzyme can be, for example, a unidirectional site-specific recombinase, a bidirectional site-specific recombinase, a nuclease (for example zinc-finger nuclease, meganuclease, TAL effector), a transposase, a resolvase, a gyrase, or a methyl transferase, as well as a histone-deacetylase, histone-deacetylase inhibitor, etc.

The use of the vectors of the invention for transiently expressing a DNA-modifying enzyme is particularly advantageous, as compared to other typical methods used in the art. For instance, the potential insertion of a recombinant vector genome encoding said DNA-modifying enzyme is of potential harm to the cell or organism. Indeed, DNA-modifying enzymes may, for example, display off-target activities, i.e., non-specific modification of the target DNA or chromatin, potentially leading to genotoxicity, chromosomal aberrations or cell death. The vectors of the invention allow to transiently express the DNA-modifying enzyme, thereby preventing the risk of permanent integration of the genome encoding the DNA-modifying enzyme and consequently reducing the risk of off-target activities.

In another particular embodiment, the vectors of the invention can be used to transiently express a differentiation factor in a pluripotent or totipotent cell such as a primary stem cell (embryonic, foetal, juvenile or adult stem cell), an embryonic stem cell line (i.e., ES cells), a progenitor cell, or an induced pluripotent stem cell (iPS). Such a differentiation factor can be selected for example from a transcription factor, an epigenetic regulatory factor, a cell cycle modifier, etc., either natural or synthetic.

The use of the vectors of the invention for transiently expressing a differentiation factor is particularly advantageous, as compared to other typical methods used in the art. For instance, the potential insertion of a recombinant vector genome encoding said differentiation factor is of potential harm to the cell or the organism. Indeed, random integration of the recombinant vector genome into the genome of the host cell may induce insertional mutagenesis. Moreover, the vectors of the invention allow to transiently express the differentiation factor, thereby preventing the risk of long-term or constitutive expression of a differentiation factor, reducing potential harmful effects of the differentiation factor and thus allowing to tightly control the duration of the expression of the differentiation factor to the needed time.

In another particular embodiment, the vectors of the invention can be used to transiently express at least one dedifferentiation factor, typically between two and four dedifferentiation factors. According to methods previously described (e.g., patent application WO2009/061442 A1), one can induce the dedifferentiation of a differentiated cell into a stem cell-like cell and, for example, generate so-called "iPS", typically from an animal, preferentially a mammal, for example a human, non-human primate, swine (porcine), bovine, caprine, canine, or feline.

This dedifferentiation can be achieved by transient delivery of one or several factors such as oct-4, sox-2, kfl-4, myc and any combination thereof, using the vectors of the invention.

The use of the vectors of the invention for transiently expressing a dedifferentiation factor is particularly advantageous, as compared to other typical methods used in the art. For instance, the potential insertion of a recombinant vector genome encoding said dedifferentiation factor is of potential harm to the cell or organism. Indeed, random integration of the recombinant vector genome into the genome of the host cell may induce insertional mutagenesis. Moreover, the vectors of the invention allow to transiently express the dedifferentiation factor, thereby preventing the risk of long-term or permanent expression of a dedifferentiation factor, reducing potential harmful effects of the dedifferentiation factor and thus allowing to tightly control the duration of the expression of the dedifferentiation factor to the needed time. Indeed, dedifferentiation factors are often oncogenic and their permanent expression may thus induce the generation of cancer cells.

Another field wherein the present invention can be used relates to vaccination. Retroviral vectors of the invention are particularly suitable for use in the field of medicinal treatment where especially an immune response, including a cellular immune response, elicited by endogenously expressed antigen is beneficial or necessary; accordingly, the invention provides tools for the design of vaccination protocols for use in hosts in need of preventive or curative treatment against intracellular pathogenic organisms, including viruses, or more generally against a pathogenic state, including to perform gene therapy in vivo. In particular, the invention is appropriate to elicit a cellular immune response, which may be protective when administered to a host, especially when prevention or treatment of viral infection is desired, and possibly to prevent development of pathogenesis associated with the infection.

In the context of eliciting an immune response, preferably a cellular immune response, either for a prophylactic or a therapeutic purpose, retroviral vectors of the invention are intended to transduce antigen-presenting cells, and especially dendritic cells. They are thus pseudotyped with a glycoprotein enabling the fusion of said retroviral vector particle of the invention with the target dendritic cells, preferably the VSV glycoprotein, as herein described.

Prophylactic and/or therapeutic vaccination using the vector of the invention can be used to treat human as well as non-human animals, preferably mammals or avian species. Examples of mammalian subjects include, without limitation, humans, non-human primates, dogs, cats, rodents, cattle, horses, sheep, and pigs. Examples of avian subjects include, without limitation, chicken, quail, turkey, duck or goose.

The use of retroviral vectors of the invention allows the transient expression of an antigen for inducing an immune reaction along with optimized conditions regarding safety since the unique RNA state of the retroviral vector genome prevents any persistence of the genetic information in the target cell. As a consequence, such transient retroviral vectors can be advantageously used for vaccination of a subject against any retrovirus, for example for the vaccination of human subjects against HIV infection, without any risk of recombination of the vector genome with the wild-type viral genome, thus precluding any risk of dissemination of the vector genome.

Other advantages and applications of the invention are illustrated in greater detail in the following examples, which must be considered as illustrative and non-restrictive.

KEYS TO THE FIGURES

FIG. 1: Relationship of Retrovirus Groups.

The relationships are based on amino acid sequence similarities in the reverse transcriptase protein of the groups shown. The insertion of a sequence from another source is indicated (arrows), typically the accessory and/or regulatory genes, such as bel 1, bel 2, tat, rev, sag, tax, and rex. Lentiviruses, oncoretroviruses (MLV-related, D-type retroviruses, B-type retroviruses, ALV-related retroviruses, BLV-HTLV group) and spumaviruses (also herein identified as foamy viruses) are represented. Note that the scale is approximate and not necessarily linear. (HERV-C, an ancient endogenous provirus of humans; SMRV, squirrel monkey retrovirus; HSRV, human spumavirus (also herein identified as human foamy virus); MLV, murine leukemia virus; HIV, human immunodeficiency virus; MMTV, mouse mammary tumor virus; IAP, intracisternal type A particle, a murine endogenous retrovirus; RSV, Rous sarcoma virus; BLV, bovine leukemia virus; HTLV, human T cell leukemia virus.)

FIG. 2: Retroviral Cycle.

The retroviral cycle first requires the binding of the particle to the cell membrane, followed by cell entry and uncoating of the particle. The uncoating step leads to the introduction into the cytoplasm of the nucleoproteic core, consisting of gag- and pol-derived proteins, full-length genomic RNA (2 molecules) and RT (reverse transcriptase) protein. While this core is progressing toward the cell nucleus the reverse transcription occurs, leading to the generation of a double-stranded DNA molecule from the RNA vector genome, namely the provirus. After nuclear import, the nucleoproteic complex is named preintegration complex (PIC). The DNA genome is then processed by the integrase (IN) protein, which mediates the recombination within the host cell chromatin, leading to the stable integration of the genome into a host cell chromosome. Another possible fate of the vector genome is circularization. This process involves different cellular and viral factors; the genome thus remains in the cell nucleus as an extrachromosomal DNA circle. Both DNA forms, integrated as well as circular extrachromosomal forms, can be transcribed by the host cell machinery, leading to the production of RNA, which can be exported to the cell cytoplasm. These newly-formed RNAs can subsequently be translated, leading to expression of viral proteins necessary for generating new particles, which encapsidate unspliced RNA genomic molecules and are released from the cell by budding. The maturation of the particle then occurs outside of the cell.

FIG. 3: Mechanism of Reverse Transcription in Retroviruses.

During the reverse transcription, first strand synthesis is similar for all retroviruses. (1) The first strand (−) synthesis is initiated by the binding of a specific tRNA on the Primer Binding Site, a sequence of 18 nucleotides, located in 3' from the 5' LTR. The U5 and R regions of the 5' LTR are synthesised by elongation of the tRNA thanks to the DNA polymerase activity of the reverse transcriptase while the corresponding RNA matrix fragments, with the exception of the PBS region, are degraded thanks to the RNAseH activity of the reverse transcriptase. (2) This first synthesized fragment, called the minus-strand strong stop DNA, jumps on the 3' LTR and the R regions of the DNA and RNA fragments hybridize. (3) The elongation of the DNA fragment is pursued on the U3 region and toward the 5' end of the RNA molecule until the PBS region. The RNAseH activity degrades the RNA matrix after the DNA synthesis. If the RNA matrix is not fully degraded, the second strand synthesis is prevented. A region is however protected from this degradation: the polypurine tract. The RNA fragment spared will be further used as a primer for the second strand synthesis. The second strand synthesis (+) occurs in a different manner for oncoretroviruses and other retroviruses.

In oncoretroviruses, (4-7) the synthesis of the second strand is initiated on the polypurine tract (PPT) sequence located in 5' of the 3' LTR. The elongation progresses toward the U5 region at the 3' end of the genome, using the (−)

strand DNA as a template. Meanwhile, minus-strand synthesis continues through the genome, using the (+) strand RNA as a template and removing the RNA template in its wake via RNAseH activity. The PPT initiated (+) strand stops after copying the annealed portion of the RNA to generate the (+) strand DNA form of the PBS, forming the (+) strand strong stop product. The tRNA is then removed by the RNAseH activity of the reverse transcriptase. This may facilitate annealing to the PBS complement on the (−) strand DNA, providing the complementarity for the second jump (intramolecular). DNA synthesis then continues. Strand displacement synthesis by reverse transcriptase to the PBS and PPT ends, and/or repair and ligation of a circular intermediate, produces a linear duplex with long terminal repeats (U3-R-U5) at both ends.

In lentiviruses and foamy viruses, (4-7) the mechanism is quite similar except that initiation occurs on 2 sites: the PPT located in 3' of the first strand and an additional PPT located in the centre of the first strand: the central polypurine tract (cPPT). A central termination sequence is located in 3' of the cPPT and stops the (±) strand synthesis initiated from the 3' PPT. As a consequence, the reverse transcription induces a transient 3-strand structure overlapping the cPPT and the CTS, named "triplex" (6). Although this sequence is dispensable in lentiviral vectors, its presence significantly increases the transduction efficiency of the particles.

Figure 4:
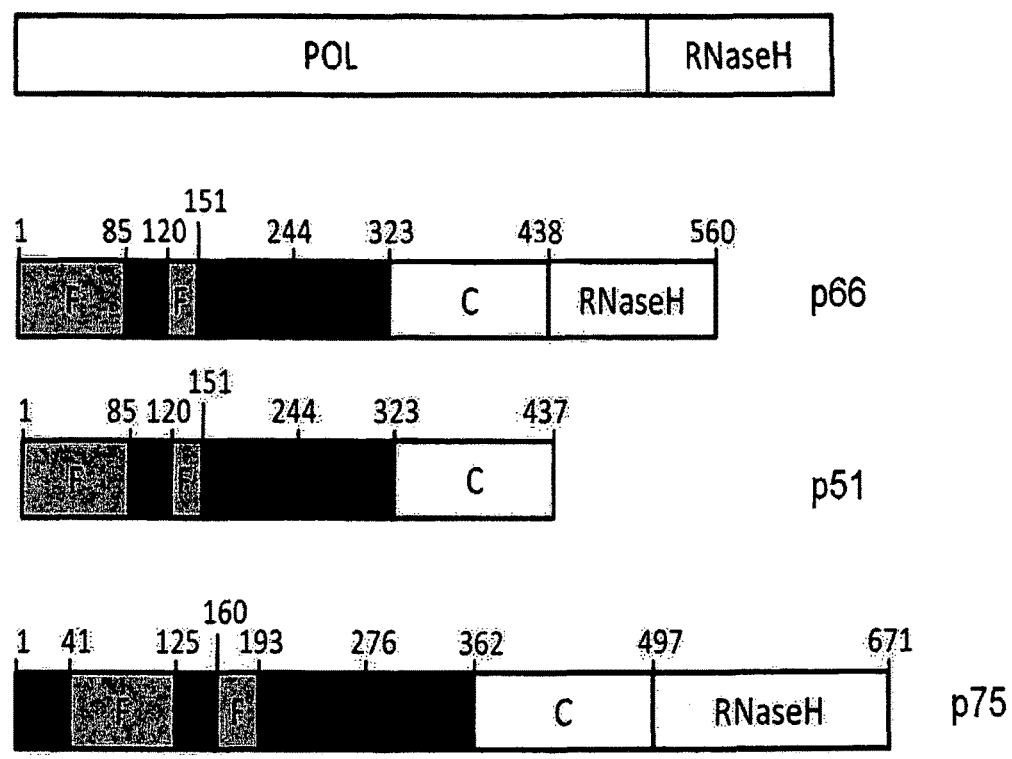

FIG. 4: Retroviral Reverse Transcriptase Structure.

Retroviral reverse transcriptases are organized in two domains, each corresponding to the two enzymatic activities of the protein: the DNA polymerase domain (POL) and the RNAseH domain. As an example, detailed organization is shown for HIV-1 and MLV reverse transcriptase. Positions of the two functional domains, as well as sub-domains, are shown for HIV-1 p66 and p51 (HIV-1 p51 being generated by protease cleavage of HIV-1 p66) and MLV p75. F: Finger domain; P: Palm domain; T: Thumb domain; C: Connection domain, the Protease cleavage site: AETF$^{440}$-Y$^{441}$VDG is located between p66 POL and RNAseH. Amino acid positions correspond to SEQ ID NO:1 numbering for HIV-1 p66 and p51 and SEQ ID NO:36 for MLV p75.

Figure 5:
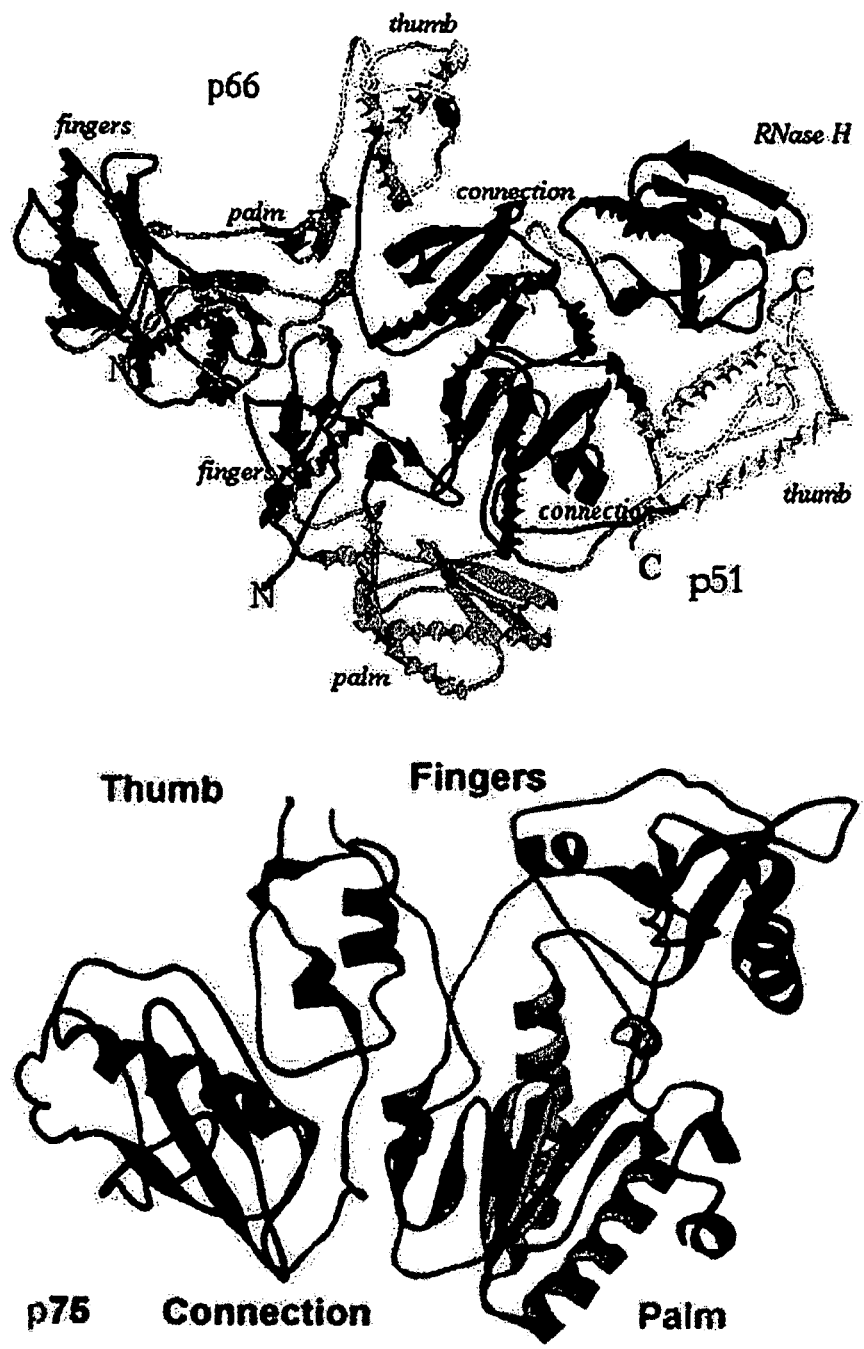

FIG. 5: Crystal Structure of Human Immunodeficiency Virus Type 1 Reverse Transcriptase Heterodimer and MLV p75 Reverse Transcriptase.

TOP: This schema figures the p66 (560 residues) and the p51 (440 residues) subunits of HIV-1 reverse transcriptase (top) and the different structural domains: the polymerase domain, which is divided into 4 subdomains: the finger, the palm, the thumb and the connection; and the RNAseH domain. C: C terminus, N: N terminus.

BOTTOM: This schema figures the different structural domains of the MLV reverse transcriptase: the polymerase domain, which is divided into 4 subdomains: the finger, the palm, the thumb and the connection; and the RNAseH domain (from Retroviral reverse transcriptases. Herschhorn A, Hizi A. Cell. Mol. Life Sci. 2010 August; 67(16):2717-47. Epub 2010 Apr. 1).

Figure 6:
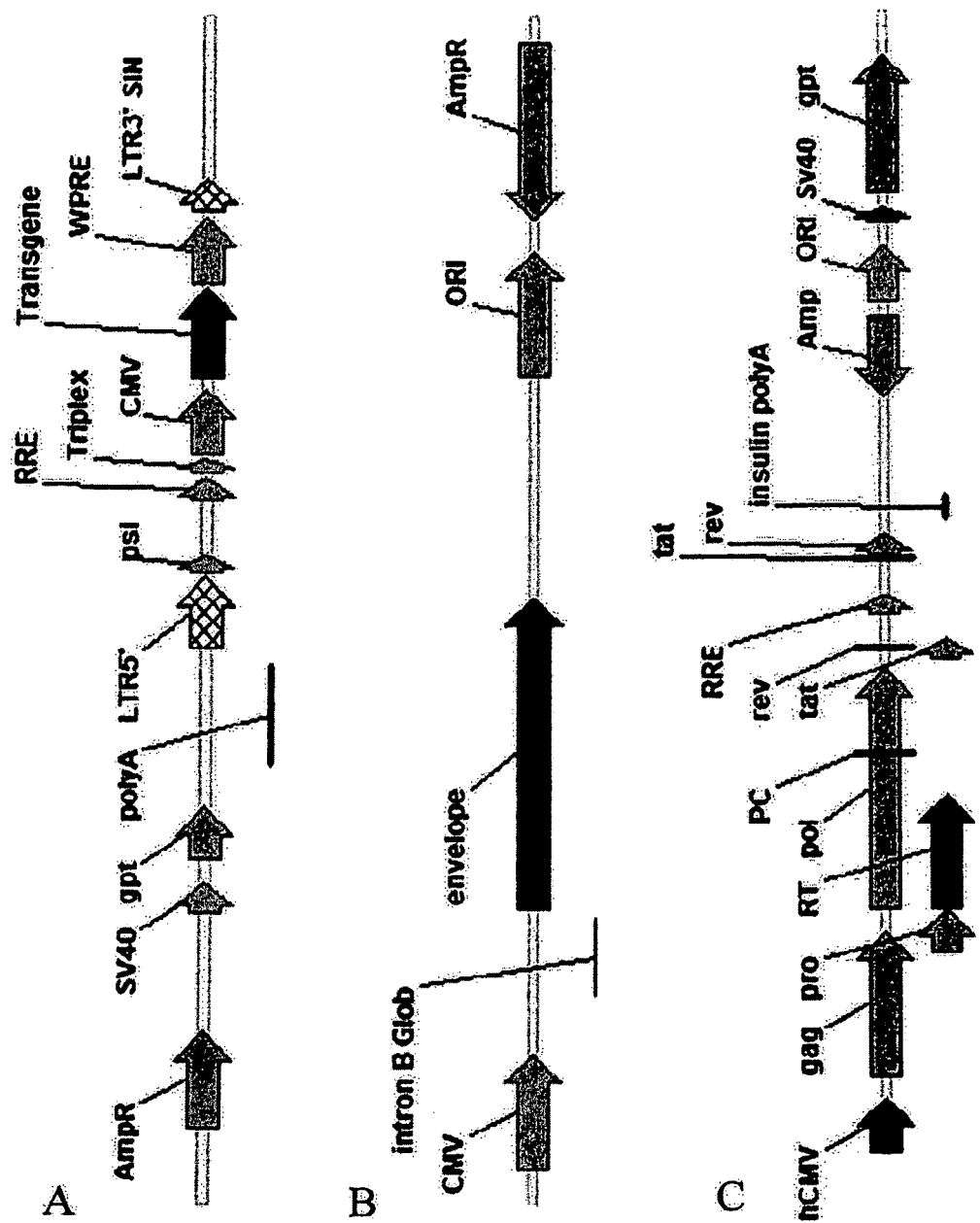

FIG. 6: Schematic Representation of a 3-Plasmid System Used for Production of HIV-1 Lentiviral Vectors by Transient Transfection.

A: The vector plasmid contains the backbone bacterial sequences, including the Ampicillin resistance gene (AmpR), the bacterial promoter (SV40), the glutamic-pyruvate transaminase coding sequence (gpt), a polyadenylation signal (polyA), and the retroviral vector elements, including the 5' and the 3' Long Terminal Repeats (LTRS' and Self Inactivating LTR3' SIN), the Rev Responsive Element (RRE), the triplex or cPPT-CTS (central polypurine tract—central termination sequence), the expression cassette, possibly including a promoter, for example a CMV promoter, at least one transgene coding sequence and regulatory elements such as WPRE, and an encapsidation signal (Psi).

B: The transcomplementation envelope plasmid contains the backbone bacterial sequences, including the Ampicillin resistance gene AmpR, the bacterial origin of replication (ORI), sequences active in eukaryote cells, the sequence encoding for a particular envelope glycoprotein envelope under the control of a promoter, for example a CMV promoter, and possibly regulatory elements, such as the beta globin intron (Intron B Glob).

C: The transcomplementation capsid plasmid contains the backbone bacterial sequences, including the Ampicillin resistance gene (Amp), the bacterial promoter (SV40), the glutamic-pyruvate transaminase coding sequence (gpt), the bacterial origin of replication (ORI), and eukaryote elements: sequences encoding for the structural and enzymatic proteins required for the formation of a particle under the control of a promoter, for example the CMV promoter (hCMV). It particularly contains the gag gene; it also possibly contains the pol gene, transcription of which may lead to the formation of the reverse transcriptase. Modifications of the coding sequence are introduced in this region to produce reverse transcription deficient HIV-1 particles; pol also encodes for the integrase (IN) and the protease (PR). Other genes are gag, encoding for the capsid (CA), the matrix (MA), the nucleoocapsid (NC), tat and rev. The plasmid also includes a polyadenylation signal (insulin polyA).

Figure 7:
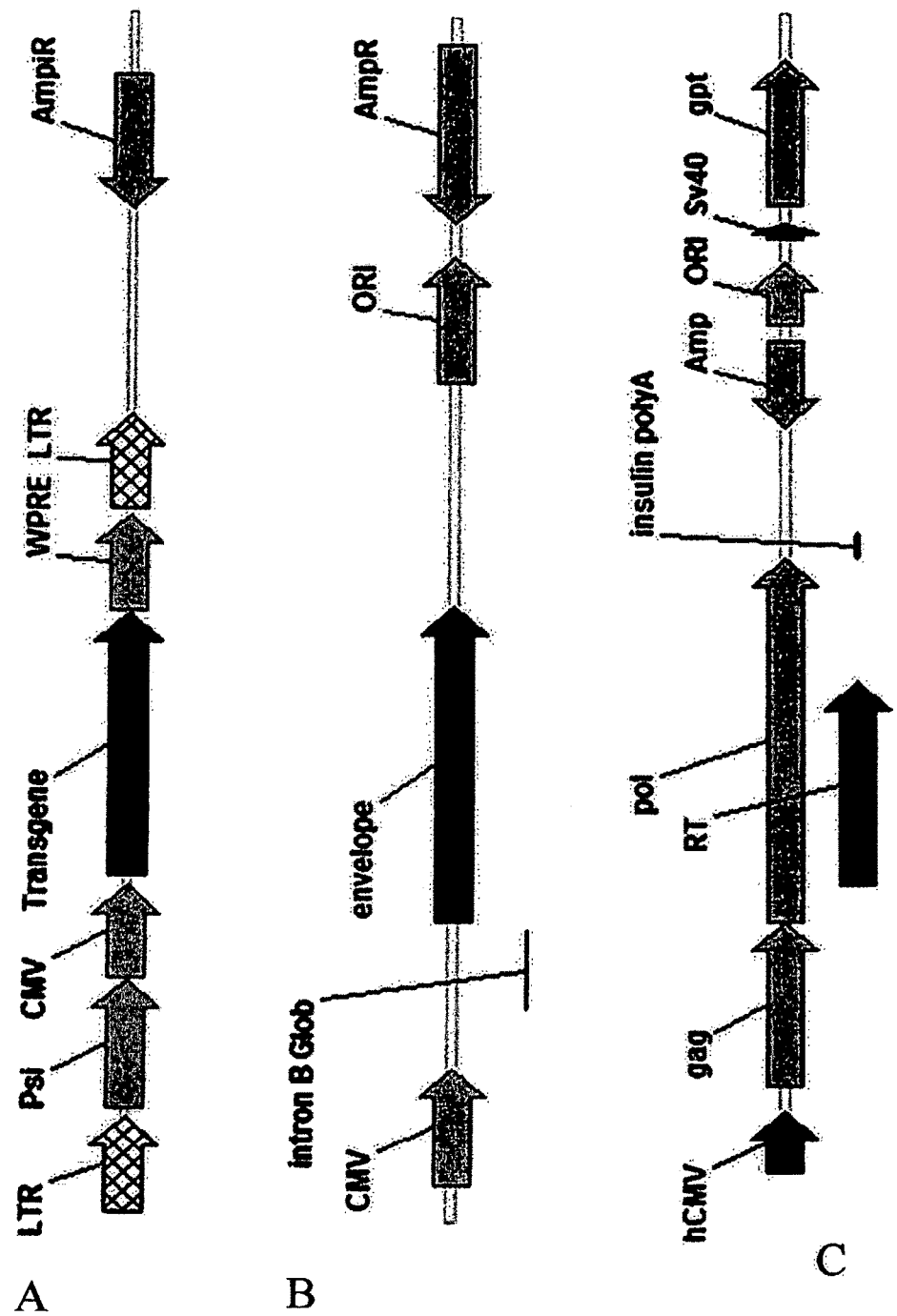

FIG. 7: Schematic Representation of a 3-Plasmid System Used for Production of MLV Oncoretroviral Vectors by Transient Transfection.

A: The vector plasmid contains the backbone bacterial sequences, including the Ampicillin resistance gene (AmpiR), and the retroviral vector elements, including the 5' and the 3' Long Terminal Repeats (LTR), an encapsidation signal (Psi), the expression cassette, possibly including a promoter, for example a CMV promoter, at least one transgene coding sequence and regulatory elements, for example WPRE.

B: The transcomplementation envelope plasmid contains the backbone bacterial sequences, including the Ampicillin resistance gene (AmpR), the bacterial origin of replication (ORI), and eukaryote elements: sequences encoding for a particular envelope glycoprotein under the control of a promoter, for example the CMV promoter, and possibly regulatory elements, for example the intron of the beta globin gene (Intron B Glob).

C: The transcomplementation capsid plasmid contains the backbone bacterial sequences, including the Ampicillin resistance gene (Amp), the bacterial promoter (SV40), the bacterial origin of replication (ORI), and eukaryote elements: sequences encoding for the structural and enzymatic proteins required for the formation of a particle under the control of a promoter, for example the CMV promoter (hCMV). It particularly contains the gag gene; it also possibly contains the pol gene, transcription of which may lead to the formation of the reverse transcriptase. Modifications of the coding sequence are introduced in this region to produce reverse transcription deficient MLV particles; pol also encodes for the integrase (IN) and the protease (PR). Other genes are gag, encoding for the capsid (CA), the matrix (MA), and the nucleocapsid (NC). The plasmid also includes a polyadenylation signal (insulin polyA).

Figure 8:
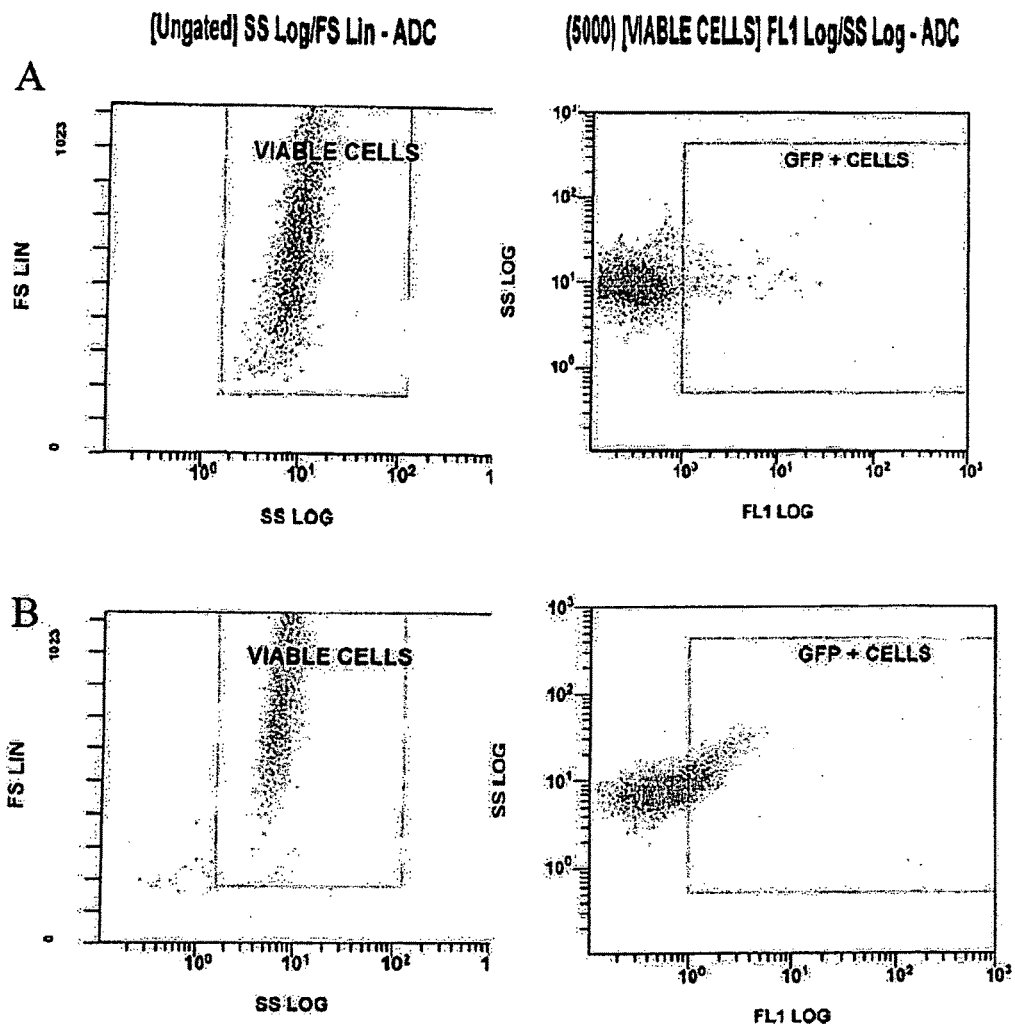
Figure 8:
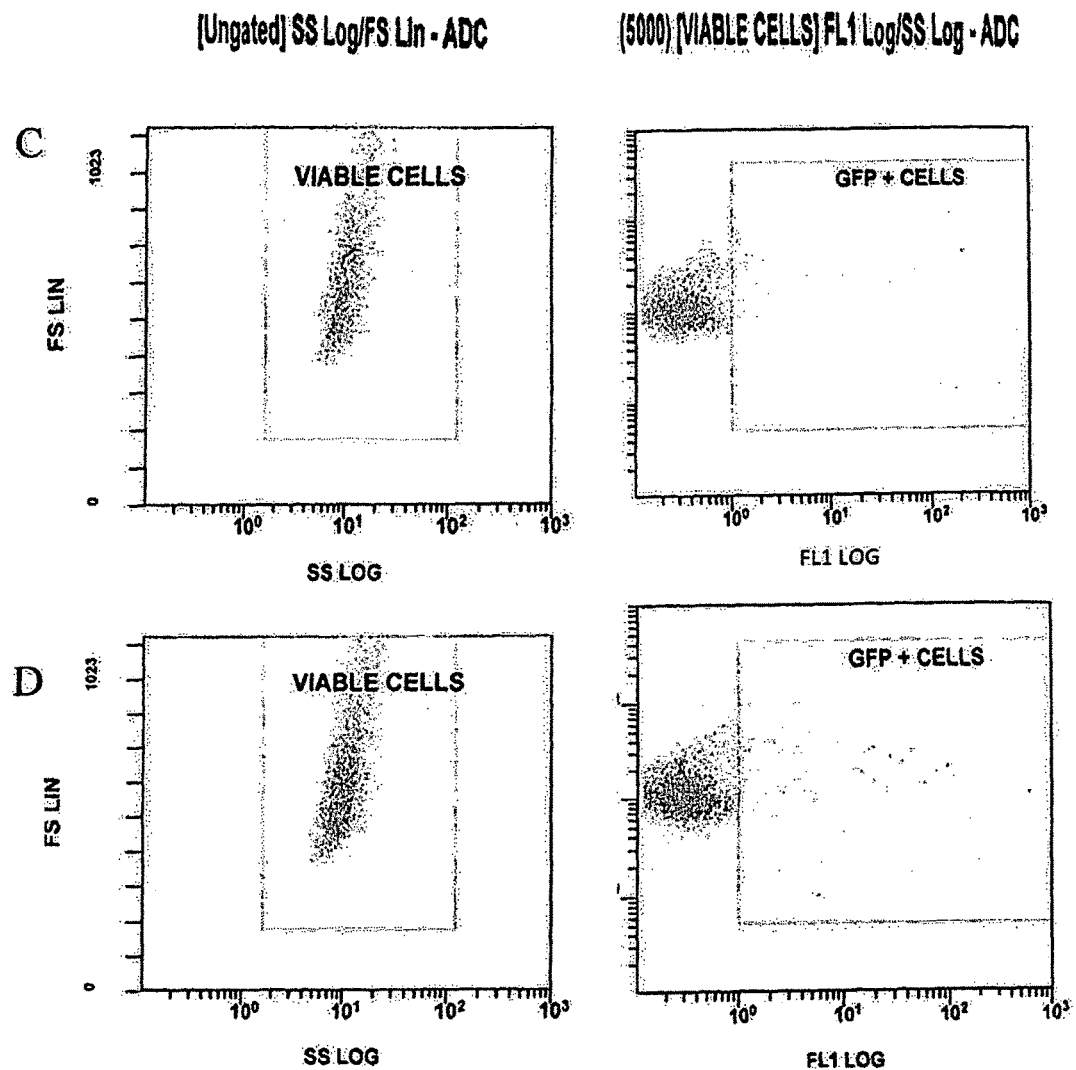

FIG. 8: GFP Expression Mediated by Reverse Transcription Deficient HIV-1 Vectors.

400,000 293T cells or 100,000 293T cells are transduced with 10µl of deficient RT-D110E HIV-1 vector, grown respectively for 24 (A) or 48 (B) hours, dissociated and fixed in paraformaldehyde before they are analysed by FACS. 120,000 293T cells are transduced with 10 µl of deficient RT-E478Q HIV-1 vector (C) or deficient RT-D110E+E478Q HIV-1 vectors (D), grown for 48 hours, dissociated and fixed in paraformaldehyde before they are analysed by FACS. (For A, B, C and D: right panel: identification of the living cells, left panel: identification of the fluorescent cells.)

Figure 9:
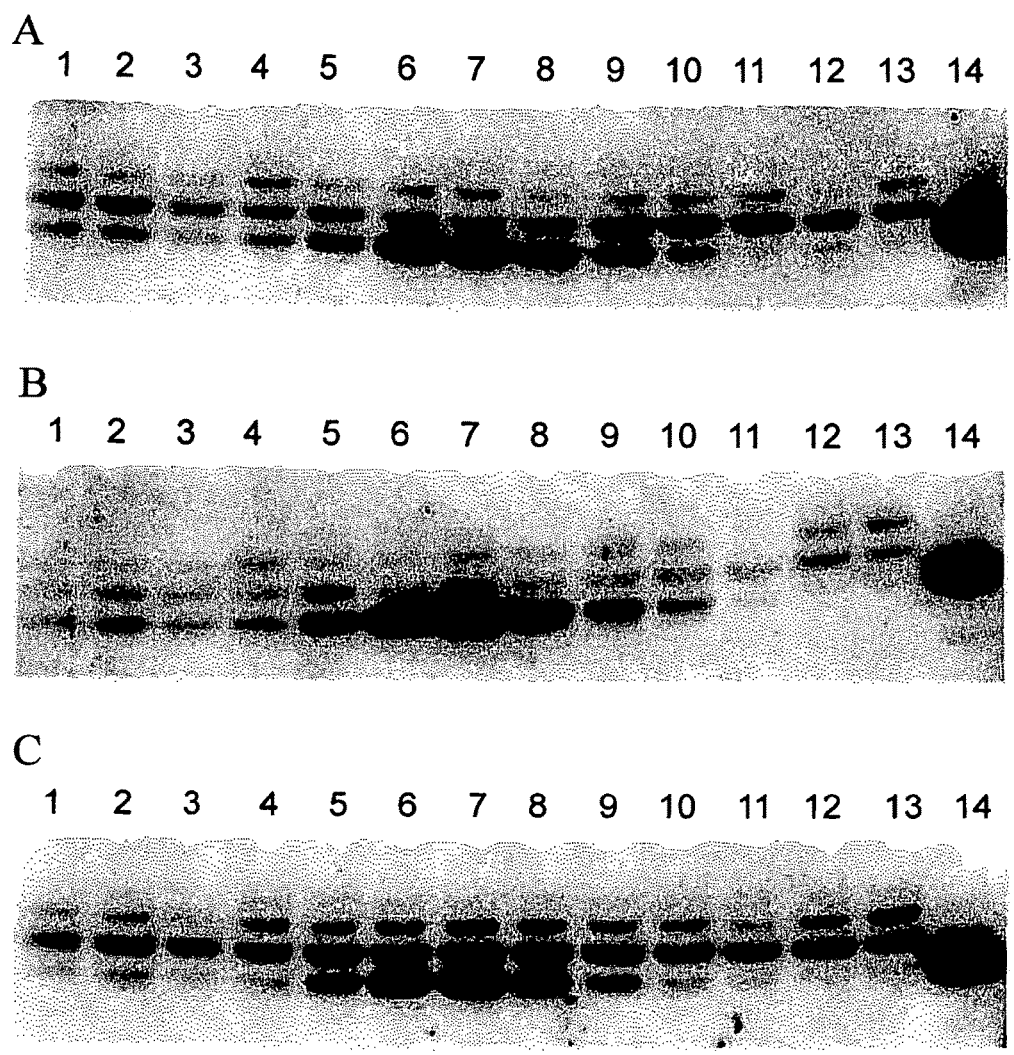

FIG. 9: Kinetics of GFP Expression Mediated by Reverse Transcription Deficient HIV-1 Vectors.

293T cells are seeded in 12-well plates and transduced with a single dose (4 µl) of vector particle deficient RT-D110E vector (A), or deficient RT-E478Q HIV-1 vector (B), or deficient RT-D110E+E478Q HIV-1 vectors (C) for reverse transcriptase. Cells are harvested at different time points and protein extracts are submitted to Western blot analysis to detect GFP expression (primary antibody: Abcam ab290, revelation ECL+GE Healthcare). (For A, B and C: 1: 4 hours, 2: 8 hours, 3: 24 hours, 4: 32 hours, 5: 48 hours, 6: 3 days, 7: 5 days, 8: 6 days, 9: 7 days, 10: 8 days, 11: 12 days, 12: 9 days, 13: 16 days, 14: GFP positive control.)

Figure 10:
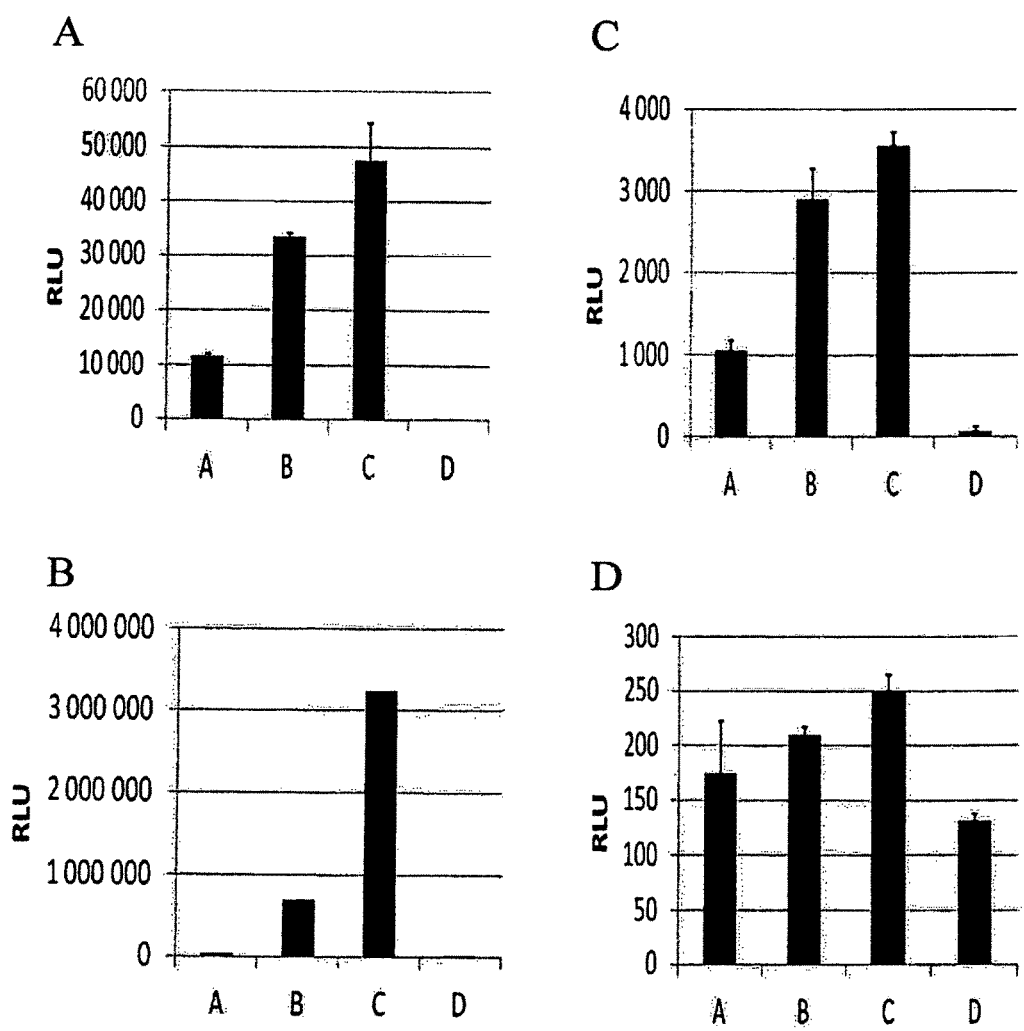
Figure 10:
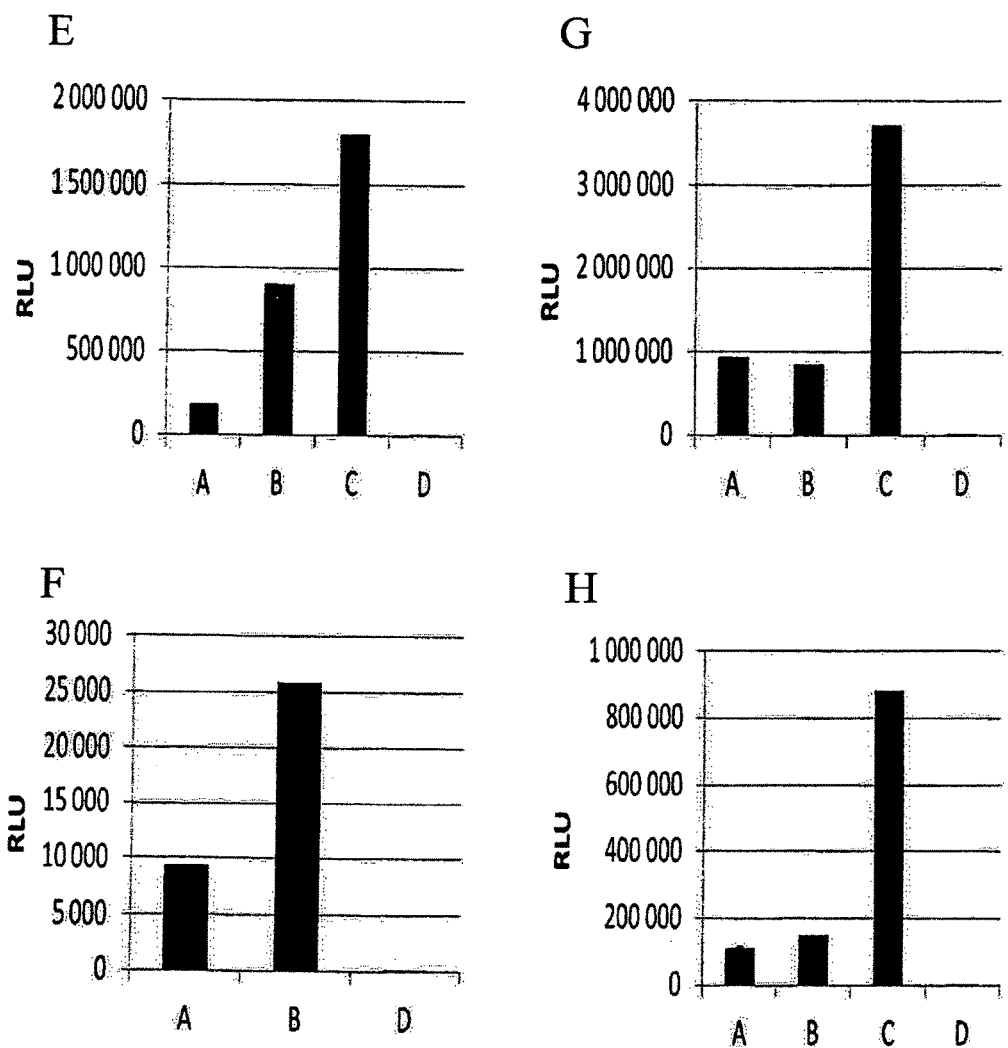

FIG. 10: Luciferase Expression Mediated by Reverse Transcription Deficient HIV-1 Vectors.

293T cells are seeded in 96-well plates and transduced in triplicate with increasing amounts of various vector particles (0 µL, 1 µL, 3 µL and possibly 5 µL). Cells are harvested 24 or 48 hours after transduction and processed with the Bright Glow Luciferase kit (Promega), according to manufacturer's protocol (10 µL lysate per well). Luciferase activity is measured by a luminometer. Results are expressed as Relative Light Units (RLU) per 10 µL of lysate and displayed as mean of 3 samples per condition +/− standard deviation (SD). (A: 1 µL; B: 3 µL; C: 5 µL, D: control cells.)

A panel: RT-D110E deficient HIV-1 vectors produced with the vector plasmid encoding the Luciferase (SEQ ID NO:66). Cells are harvested at 24 hours.

B panel: RT-D110E deficient HIV-1 vectors produced with the vector plasmid encoding the Luciferase (SEQ ID NO:66). Cells are harvested at 48 hours.

C panel: RT-D110E deficient HIV-1 vectors produced with the vector plasmid encoding the Luciferase (SEQ ID NO:50). Cells are harvested at 24 hours.

D panel: RT-E478Q deficient HIV-1 vectors produced with the vector plasmid encoding the Luciferase (SEQ ID NO:66). Cells are harvested at 24 hours.

E panel: RT-E478Q deficient HIV-1 vectors produced with the vector plasmid encoding the Luciferase (SEQ ID NO:66). Cells are harvested at 48 hours.

F panel: RT-E478Q deficient HIV-1 vectors produced with the vector plasmid encoding the Luciferase (SEQ ID NO:50). Cells are harvested at 48 hours.

G panel: RT-D110E+E478Q deficient HIV-1 vectors produced with the vector plasmid encoding the Luciferase (SEQ ID NO:66). Cells are harvested at 48 hours.

H panel: RT-D110E+E478Q deficient HIV-1 vectors produced with the vector plasmid encoding the Luciferase (SEQ ID NO:67). Cells are harvested at 48 hours.

Figure 11:
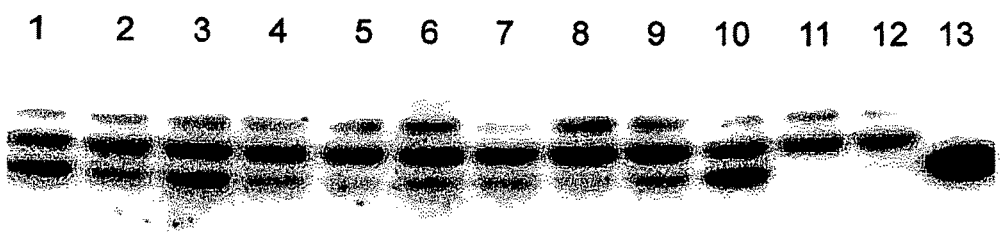

FIG. 11: GFP Expression Mediated by Reverse Transcription Deficient RT-E478Q, RT-D110E and RT-D110E+E478Q HIV-1 Vectors in the Presence of an Inhibitor of Reverse Transcriptase.

293T cells are seeded in 12-well plates and transduced with a single dose (4 µl) of vector particles deficient for reverse transcriptase in the presence of 0.1 mM chloroquine, an inhibitor of endosome acidification, or 10 µM azidothymidine (AZT), an inhibitor of HIV-1 reverse transcriptase, or in control medium. Cells are harvested 24 hours after contact with the particles and proteins extracts are submitted to Western blot analysis to detect GFP expression (primary antibody: Abcam ab290, revelation ECL+GE Healthcare). (1: RT-D110E, normal medium, 2: RT-D110E, chloroquine medium, 3: RT-D110E, AZT medium, 4: RT-E478Q, normal medium, 5: RT-E478Q, chloroquine medium, 6: RT-E478Q, AZT medium, 7: RT-D110E+E478Q, normal medium, 8: RT-D110E+E478Q, chloroquine medium, 9: RT-D110E+E478Q, AZT medium, 10: RT-WT, normal medium, 11: RT-WT, chloroquine medium, 12: RT-WT, AZT medium, 13: GFP positive control.)

Figure 12:
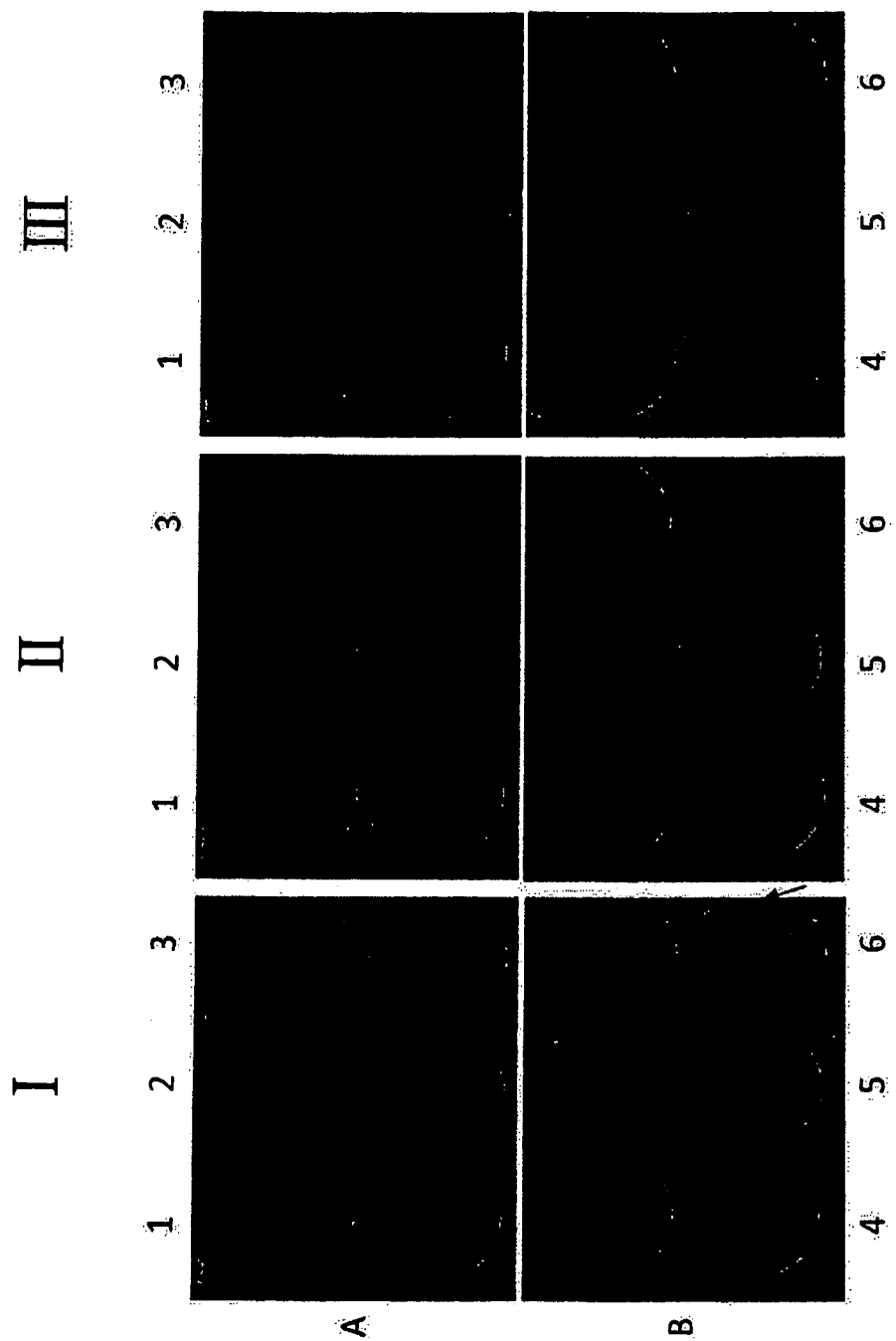

FIG. 12: Residual Integration Frequency of Reverse Transcription Deficient HIV-1 Vectors.

Selection of G418 resistant colonies after transduction of HeLa cells with different doses of control vector reverse transcriptase proficient HIV-1 vectors (A1: 0.1 µL; A2: 0.25 µL; A3: 0.5 µL) or reverse transcription deficient HIV-1 vectors (I: RT-D110E, II: RT-E478Q and III: RT-D110E+E478Q HIV-1 vectors, B4: 1 µL; B5: 2.5 µL; B6: 5 µL). A: cells were grown 2 days in normal medium and an additional 6 days in the presence of G418 in 6-well plates, then fixed and colored with trypan blue. B: cells were grown 2 days in normal medium and an additional 12 days in the presence of G418 in 6-well plates, then fixed and colored with trypan blue.

For I, II and III, A plates are covered by a high density of clones (uncountable), B plates contain a few clones that are indicated with arrows.

Figure 13:
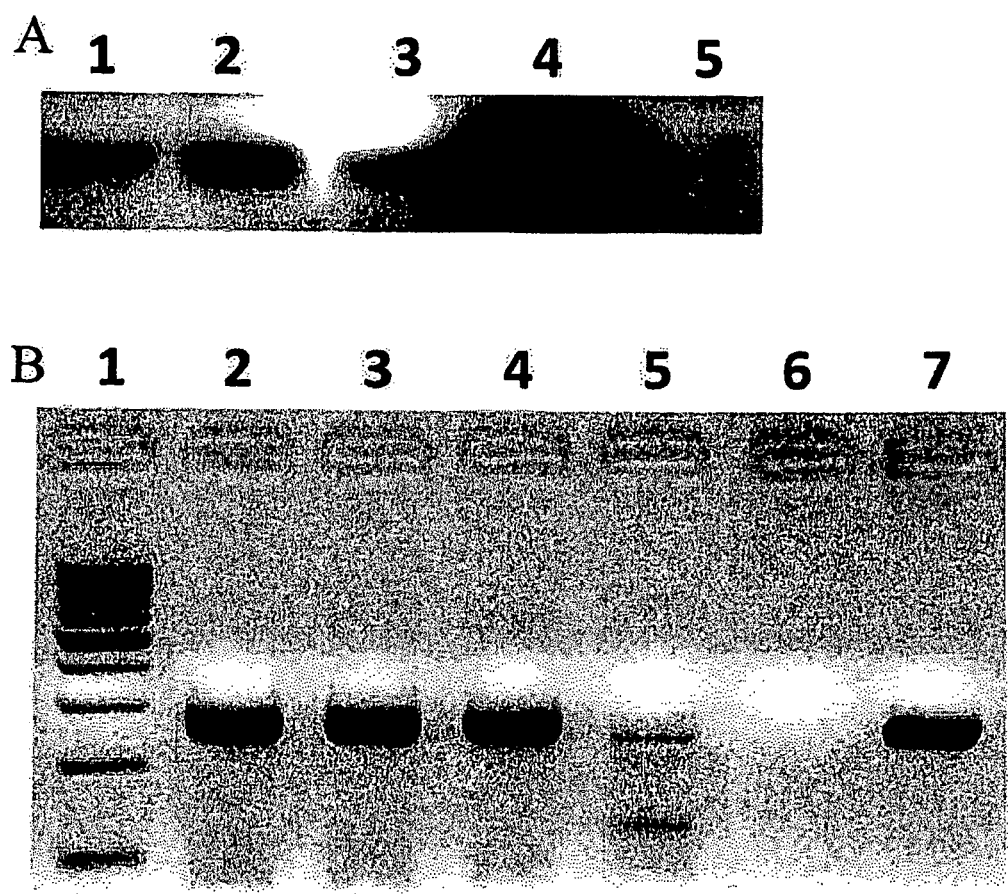

FIG. 13: NEO Expression Mediated by Reverse Transcription Deficient HIV-1 Vectors.

HeLa cells are transduced by 5 µL or reverse transcription deficient HIV-1 vectors expressing NEO (RT-D110E; RT-E478Q; D110E+E478Q) or 0.5 µL of reverse transcriptase proficient HIV-1 vectors expressing NEO (RT-WT). After transduction, cells are seeded in 6-well plates and grown for 48 hours and harvested for RNA and protein extraction.

A: Protein extracts were analysed by Western blot to detect the NEO protein (primary antibody: Abcam ab33595, revelation: ECL+GE Healthcare). (A1: RT-D110E, 20 µg protein, A2: RT-E478Q, 20 µg protein, A3: RT-D110E+E478Q, 20 µg protein, A4: RT-WT, 5 µg protein, A5: non-transduced control cells).

B: RNA extracts are analysed by RT-PCR (SuperScript III Platinum, Invitrogen, according to manufacturer indications) to detect the NEO mRNA (B1: DNA ladder, B2: RT-D110E, B3: RT-E478Q, B4: RT-D110E+E478Q, B5: non-transduced control cells, B6: H2O control, B7: RT-WT).

Figure 14:
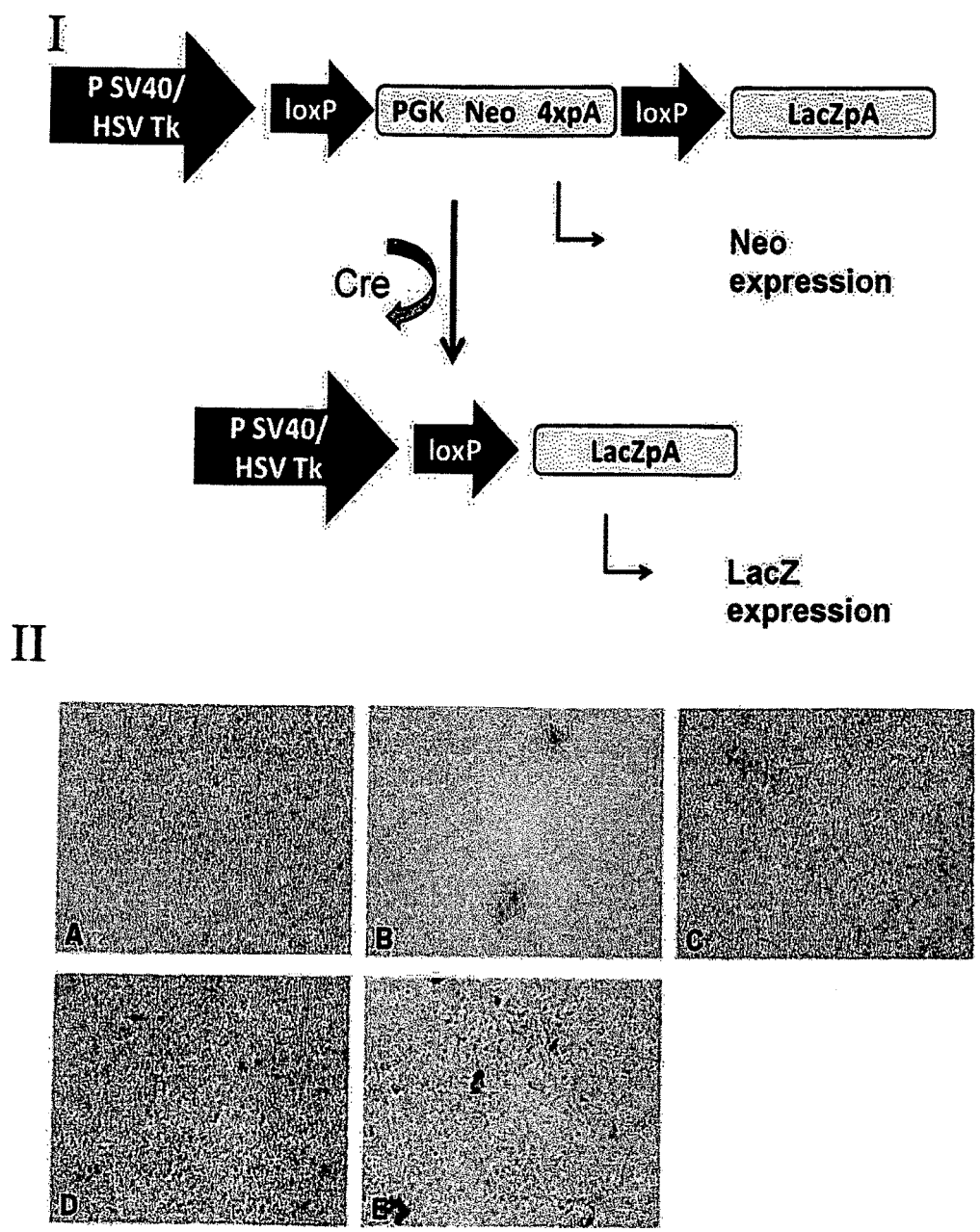

FIG. 14: The CV-1 5B Reporter Cell Line and Expression of Cre and Recombination Mediated by Reverse Transcription Deficient HIV-1 Vectors.

I: The CV-1 5B reporter cell line created by Kellendonk et al. (Kellendonk C., Tronche F., Monaghan A. P., Angrand P. O., Stewart F., Schutz G., Nucleic Acids Res. 1996; 24:1404-1411) harbours a stable integration of the pHSVtk/loxNeolox/NLS-lacZ reporter construct. Expression of the NLS-lacZ gene is only detected in cells that have undergone Cre-mediated deletion of the loxP flanked neomycin phosphotransferase gene, thus removing the PGK neo expression cassette and placing the LacZ gene under the promoter activity of pSV40/HSV Tk.

II: CV-1 5B reporter cells expressing LacZ after transduction with HIV-1 vectors deficient for reverse transcriptase, allowing transient expression of Cre recombinase, as revealed by X-Gal assay and observation of cells by white light microscopy (×10). (A: non-transduced control cells, B: 1 µL, C: 3 µL, D: 6 µL, E: 10 µL.)

Figure 15:
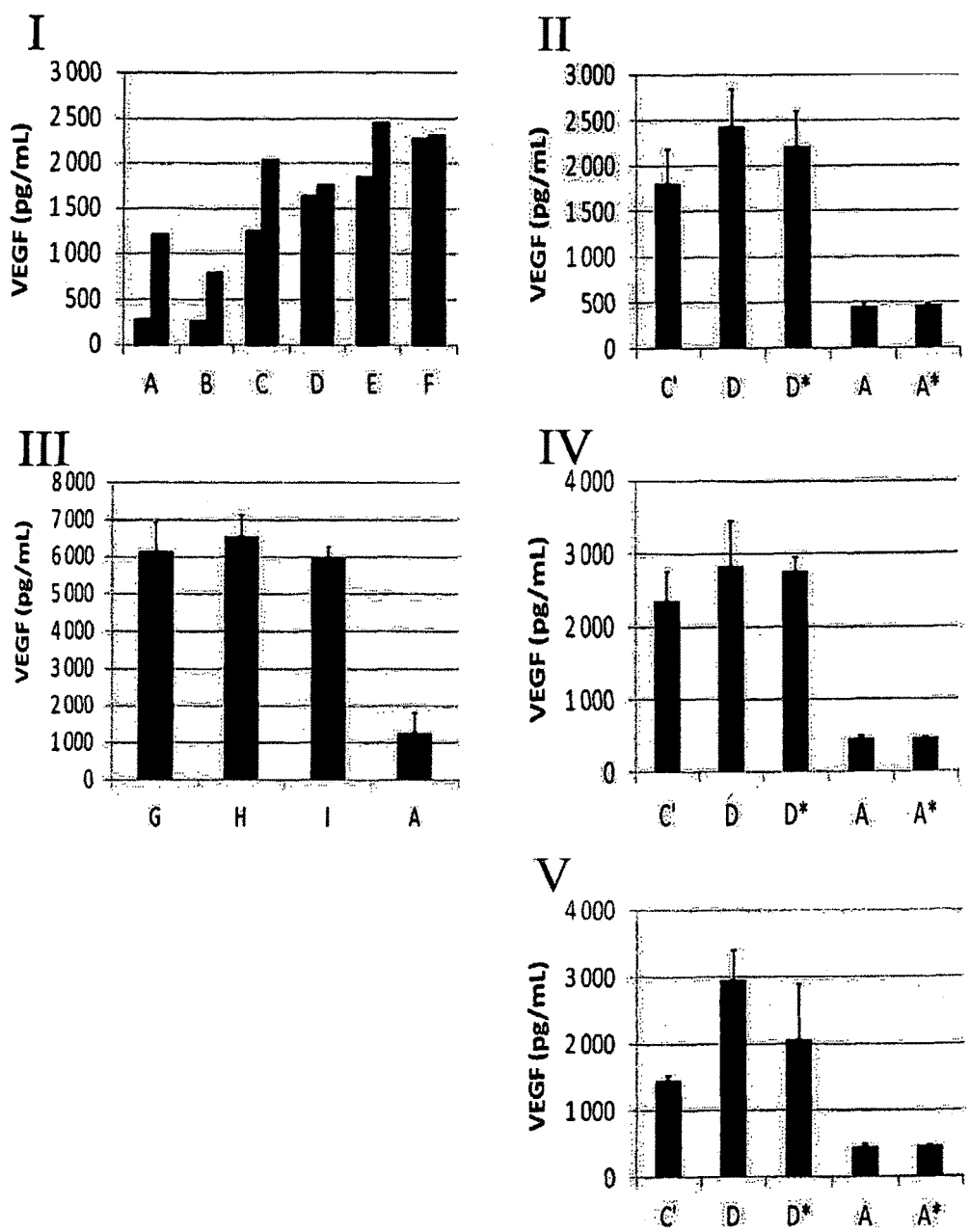

FIG. 15: Expression of VEGF Mediated by Reverse Transcription Deficient HIV-1 Vectors.

293T cells are seeded in 96-well plates and transduced with increasing amounts of reverse transcription deficient HIV-1 vectors expressing an optimized sequence coding for VEGF165a (SEQ ID NO:70 or SEQ ID NO:71), VEGF165b, or VEGF121, with or without 10 µM azidothymidine (AZT). Cells and/or culture medium are collected 60 hours after transduction and VEGF is measured by ELISA human VEGF (Invitrogen), according to manufacturer indications. Results are expressed in picogrammes of VEGF per microliter and figured as the mean of 3 samples per condition +/− standard deviation (SD).

A and B: non-transduced control cells, C: 2 µL, C': 2.5 µl, D: 5 µL, E: 10 µL, F: 15 µL of VEGF165a vector (SEQ ID NO:70), G: 5µl of VEGF121 vector, H: 5 µL of VEGF165a vector (SEQ ID NO:71), I: 5µl of VEGF165b vector; grey: cell lysate, black: cell medium;

A* and D* stand for cells treated as described above in addition to 10 µM AZT.

Vector used in experiments I and II is RT-D110E HIV-1 vector. Vector used in experiments III and IV is RT-D110E+E478Q HIV-1 vector. Vector used in experiment V is RT-E478Q HIV-1 vector.

Figure 16:
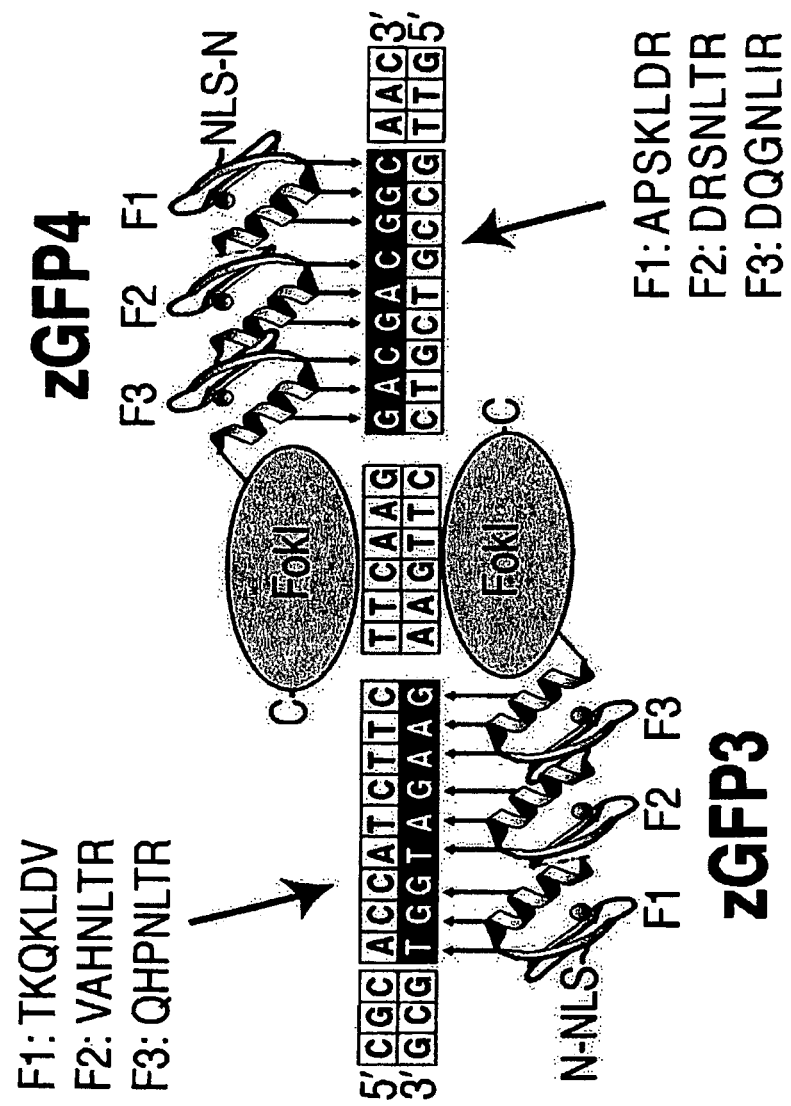

FIG. 16: Zinc Finger Nuclease Targeting the GFP Coding Sequence.

Schematic figure to show how the zinc finger nucleases used in this study recognise the EGFP coding sequence. The zinc finger recognition helices for each set of three fingers (F1-F3) were adapted from Molecular Therapy, Vol. 18, No. 6, 1103-1110, 2010 by grafting onto a zif268 backbone, with an N-terminal nuclear localisation signal (NLS) and a C-terminal FokI nuclease cleavage domain. The primary contacted DNA bases are highlighted in black.

Figure 17:
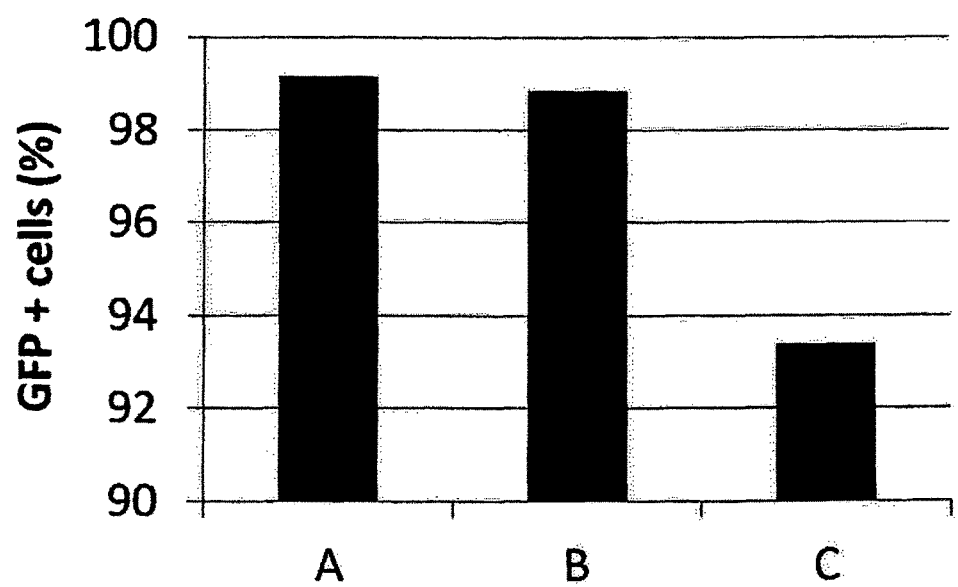
Figure 17:
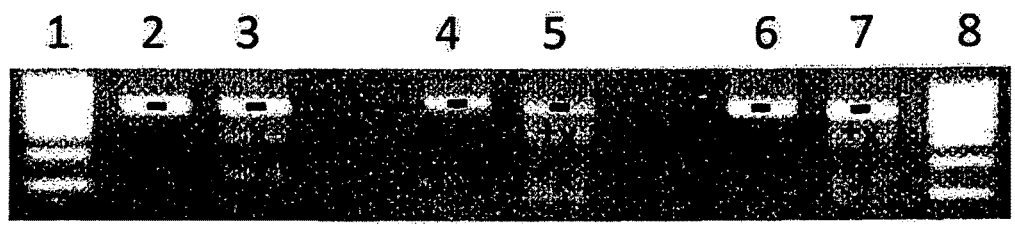
Figure 17:
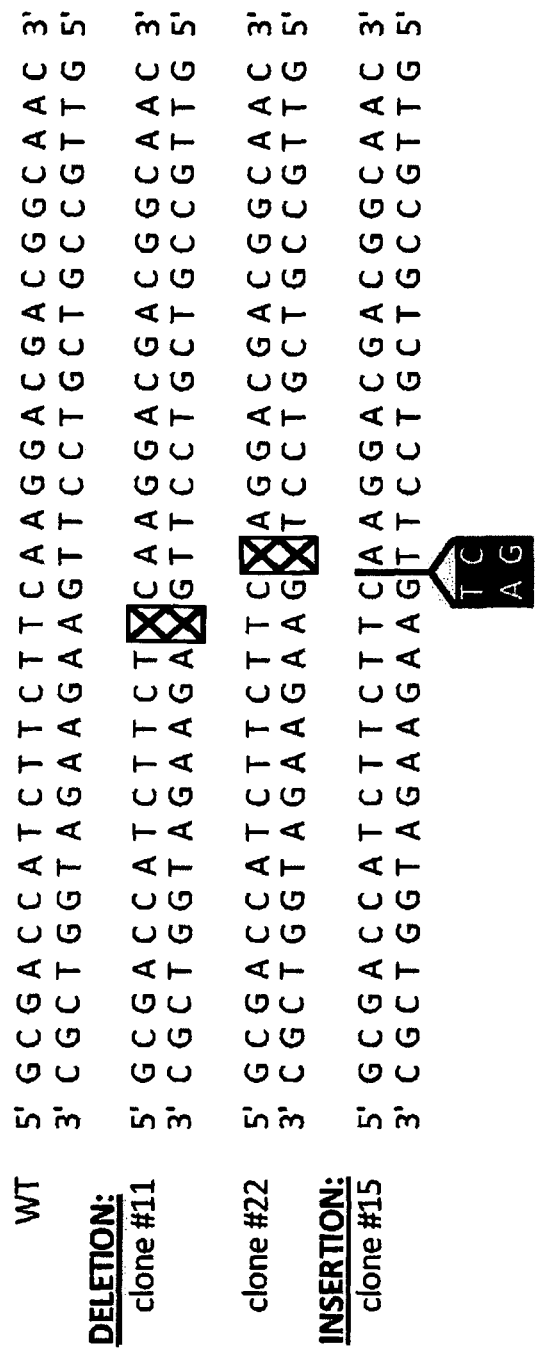

FIG. 17: Transient Expression of GFP-ZFN by Reverse Transcription Deficient HIV-1 Vector and Induction of Mutation.

I: Evidence of fluorescence extinction. HeLa H11 GFP+ cells are transduced by RT-D110E zGFP-3 and RT-D110E zGFP-4 vectors, respectively expressing zGFP-3 and zGFP-4 (10 µL each per 3,000 cells). Cells were grown for 22 days and GFP expression is analysed by FACS to measure the efficacy of GFP extinction induced by transient ZFN expression. Results are figured as the mean of 3 samples per condition +/− standard deviation (SD).

II: Evidence of mutation induced by transient expression of GFP-ZFN by reverse transcription deficient HIV-1 vector. HeLa H11 GFP+cells are transduced by RT-D110E zGFP-3 and RT-D110E zGFP-4 vectors and grown for 22 days. DNA is extracted from cells and the GFP gene surrounding the ZFN target site is amplified by PCR. After denaturation and annealing, these PCR products are incubated with Surveyor nuclease, which specifically cuts heteroduplexes, then generates smaller products. (Native fragment (−): 605 pb; generated fragments: positive control for nuclease treatment (x): 215 pb and 390 pb; generated fragments: mutation in the ZFN target site (+): 185 pb and 420 pb. 1 and 8: DNA ladder; 2: control non-transduced cells; 3: control non-transduced cells+nuclease; 4: control transduced cells; 5: control transduced cells+nuclease; 6: RT-D110E zGFP-3 and RT-D110E zGFP-4 transduced cells; 7: 6: RT-D110E zGFP-3 and RT-D110E zGFP-4 transduced cells+nuclease.)

III: Exemplification of the different kinds of mutations induced by transiently expressed ZFN through reverse transcription deficient HIV-1 vectors. This figure compares the wild-type GFP sequence (SEQ ID NO:76) and the nucleotide sequence found in 3 independent clones in which GFP expression is extinguished (SEQ ID NO:77; SEQ ID NO:78; SEQ ID NO:79).

Figure 18:
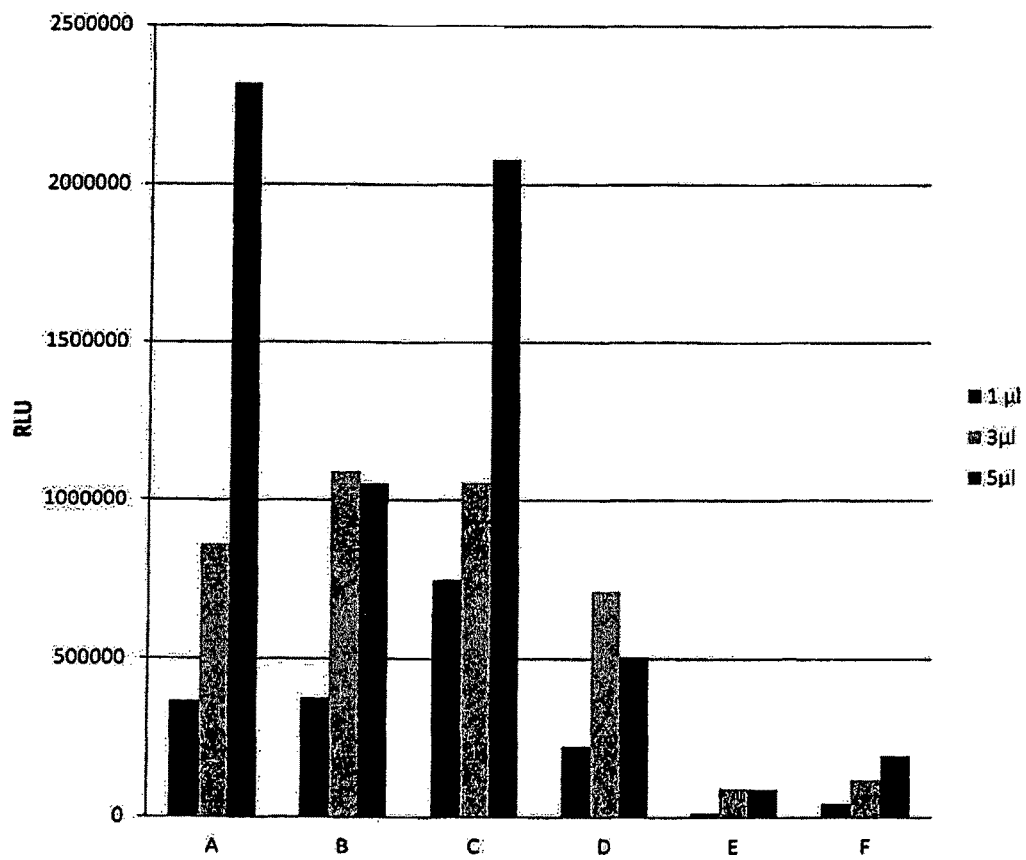

FIG. 18: Luciferase Expression Mediated by Reverse Transcription Deficient HIV-1 Vectors.

293T cells are seeded in 96-well plates and transduced in triplicate with increasing amounts of various vector particles (1 µL, 3 µL and 5 µL). To measure luciferase activity, cells are harvested 48 hours after transduction and processed with the Bright Glow Luciferase kit (Promega), according to manufacturer's protocol (10 µL lysate per well). Luciferase activity is measured by a luminometer. Results are expressed as Relative Light Unit (RLU) per 10 µL of lysate and displayed as the mean of 3 samples per condition. (A: RT-D110E-LUC-HIV-1; B: RT-Δ90-LUC-HIV-1; C: RT-Δ787-LUC-HIV-1; D: RT-Δ877-LUC-HIV-1 vectors; E: RT-Δ2524-LUC-HIV-1 vectors; F: RT-Δ2712-LUC-HIV-1 vectors.)

Figure 19:
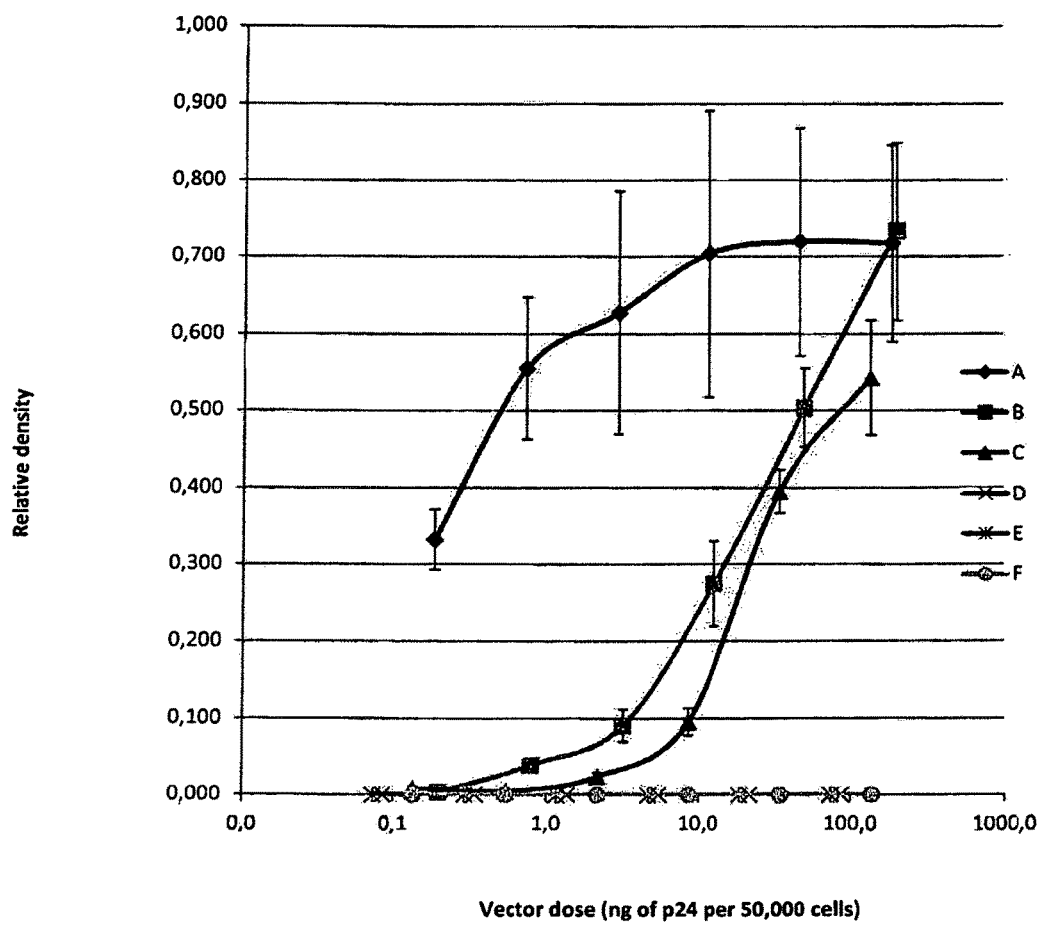

FIG. 19: Comparison of Integration Frequency of Different Reverse Transcription Deficient Retroviral Vectors.

Selection of G418 resistant colonies after transduction of HeLa cells with different doses of different types of HIV-1 vectors (A: WT, B: D64V, C: ΔPBS, D: RT-D110E, E: RT-E478Q and F: RT-D110E+E478Q). Cells are then grown for 1 day in normal medium, then with 1.5 mg/ml of G418 for 8 days for the WT and D64V vectors, 10 days for the ΔPBS vector and 15 days for the RT-D110E and RT-E478Q vectors, then fixed and stained with trypan blue. Pictures of each well are taken and analysed with Image-J software to determine relative cell density, revealing the integration frequency of the vector for each dose, as an indicator of the reverse transcription efficiency of the studied vectors. For each condition, 3 wells are evaluated and results are presented as a mean of these 3 values, +/− standard deviation.

Figure 20:
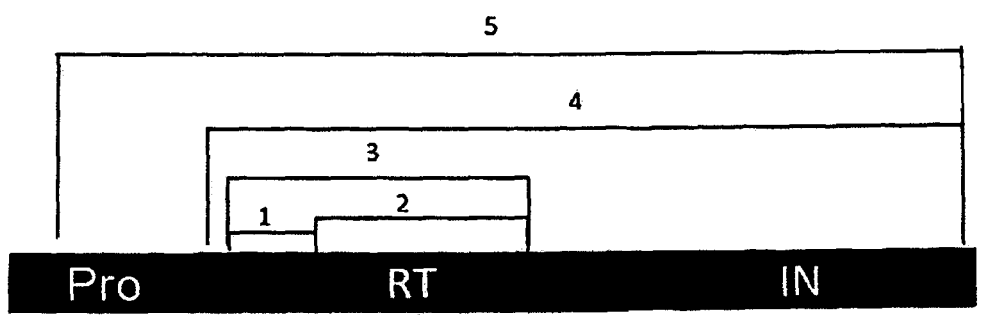

FIG. 20: Pol Gene Deletions

Schema of Different Pol Deletions:

1: RT-Δ90, deletion of 90 bp in the reverse transcriptase coding region

2: RT-Δ787, deletion of 787 bp in the reverse transcriptase coding region

3: RT-Δ877, deletion of 877 bp in the reverse transcriptase coding region

4: RT-Δ2524, deletion of 2524 bp spanning the reverse transcriptase and the integrase coding regions 5: RT-Δ2712, deletion of 2712 bp spanning the reverse transcriptase, the integrase and the protease coding regions

EXPERIMENTAL PART

Example 1: Production by Transient Transfection of HIV-1 Derived Retroviral Vectors, which Cannot on their Own Achieve Complete Reverse Transcription ("Retroviral Vectors Deficient for Reverse Transcription")

HIV-1 derived vectors, which cannot on their own achieve reverse transcription, also herein identified as reverse transcription deficient HIV-1 vectors, are produced by transient transfection of 3 particular plasmids in producer cells (see FIG. 6). These three plasmids are (i) the vector plasmid, (ii) the transcomplementation envelope plasmid and (iii) the transcomplementation encapsidation plasmid containing a possibly modified reverse transcriptase coding sequence, as herein described. Briefly, the 3 plasmids are transfected by the calcium phosphate precipitation method into HEK-293T cells. The transfected cells then produce HIV-1 vector particles including an RNA molecule and a mutant reverse transcriptase or no reverse transcriptase. These particles are recovered from the cell culture medium and subsequently used for different purposes, in vitro or in vivo, as further detailed below.

Amino acid positions of the reverse transcriptase to be advantageously mutated in the context of the invention are determined by combining structural data, rational design, literature reports, phylogenetic alignment, combinatory libraries and random mutagenesis to determine the critical positions for polymerase and RNAseH activities of the reverse transcriptase.

In a first example, SEQ ID NO:46, SEQ ID NO:47 and SEQ ID NO:48 are used. The produced vector particles are then characterized in that (1) they are enveloped with VSV glycoprotein, (2) they contain an RNA molecule allowing the expression of GFP, and (3) they contain a reverse transcriptase with a D110E substitution, which is non-functional for completing reverse transcription (the polymerase activity of the reverse transcriptase being abolished).

In a second example, SEQ ID NO:49, SEQ ID NO:50 and SEQ ID NO:51 are used. The produced vector particles are then characterized in that (1) they are enveloped with Mokola glycoprotein, (2) they contain an RNA molecule allowing the expression of Luciferase, and (3) they contain a reverse transcriptase with an E478Q substitution which is non-functional for completing reverse transcription (the RNAseH activity of the reverse transcriptase being abolished).

In a third example, SEQ ID NO:49, SEQ ID NO:50 and SEQ ID NO:61 are used. The produced vector particles are then characterized in that (1) they are enveloped with Mokola glycoprotein, (2) they contain an RNA molecule allowing the expression of Luciferase, and (3) they contain no reverse transcriptase.

In a fourth example, SEQ ID NO:49, SEQ ID NO:50 and SEQ ID NO:62 are used. The produced vector particles are then characterized in that (1) they are enveloped with Mokola glycoprotein, (2) they contain vector genome RNA molecules allowing the expression of Luciferase, and (3) they contain no reverse transcriptase, no integrase and no protease.

HIV-1 derived retroviral vectors are similarly prepared using mutations described in Table 5 below.

Preferred critical positions identified in the prototypic HIV-1 reverse transcriptase sequence (HIV-1 N5 of SEQ ID NO: 1) and substitutions advantageously affecting the polymerase activity or the RNAseH activity.
For each identified residue, the native amino acid is indicated as well as its position in the reference sequence and the possible substitutions. Any one or several of the identified residues can further be deleted or be concerned by a STOP mutation as herein defined.

| amino acid | position | mutation | | | | | | | | | | | | | | | | | | |
|---|---|---|---|---|---|---|---|---|---|---|---|---|---|---|---|---|---|---|---|---|
| G | 45  | A | C | D | E | F | — | H | I | K | L | M | N | P | Q | R | S | T | V | W | Y |
| K | 65  | A | C | D | E | F | G | H | I | — | L | M | N | P | Q | R | S | T | V | W | Y |
| R | 72  | A | C | D | E | F | G | H | — | K | L | M | N | P | Q | — | S | T | V | W | Y |
| N | 81  | A | C | D | E | F | G | H | I | K | L | M | — | P | Q | R | S | T | V | W | Y |
| D | 110 | A | C | — | E | F | G | H | I | K | L | M | N | P | Q | R | S | T | V | W | Y |
| A | 114 | — | C | D | E | F | G | H | I | K | L | M | N | P | Q | R | S | T | V | W | Y |
| F | 130 | A | C | D | E | — | G | H | I | K | L | M | N | P | Q | R | — | T | V | W | Y |
| L | 149 | A | C | D | E | F | G | H | I | K | — | M | N | P | Q | R | S | T | V | W | Y |
| P | 150 | A | C | D | E | F | G | H | I | K | L | M | N | — | Q | R | S | T | V | W | Y |
| Q | 151 | A | C | D | E | F | G | H | I | K | L | M | N | P | — | R | S | T | V | W | Y |
| G | 152 | A | C | D | E | F | — | H | I | K | L | M | N | P | Q | R | S | T | V | W | Y |
| S | 156 | A | C | D | E | F | G | H | I | K | L | M | N | P | Q | R | — | T | V | W | Y |
| Y | 183 | A | C | D | E | F | G | H | I | K | L | M | N | P | Q | R | S | T | V | W | — |
| D | 185 | A | C | — | E | F | G | H | I | K | L | M | N | P | Q | R | S | T | V | W | Y |
| D | 186 | A | C | — | E | F | G | H | I | K | L | M | N | P | Q | R | S | T | V | W | Y |
| G | 262 | A | C | D | — | F | — | H | I | K | L | M | N | P | Q | R | S | T | V | W | Y |
| W | 266 | A | C | D | E | F | G | H | I | K | L | M | N | P | Q | R | S | T | V | — | Y |
| G | 285 | A | C | D | E | F | — | H | I | K | L | M | N | P | Q | R | S | T | V | W | Y |
| E | 302 | A | C | D | — | F | G | H | I | K | L | M | N | P | Q | R | S | T | V | W | Y |
| Y | 318 | A | C | D | E | — | G | H | I | K | L | M | N | P | Q | R | S | T | V | W | — |
| E | 378 | A | C | D | — | F | G | H | I | K | L | M | N | P | Q | R | S | T | V | W | Y |
| G | 384 | A | C | D | E | F | — | H | I | K | L | M | N | P | Q | R | S | T | V | W | Y |
| E | 396 | A | C | — | — | F | G | H | I | K | L | M | N | P | Q | R | S | T | V | W | Y |
| P | 412 | A | C | D | E | F | G | H | I | K | L | M | N | — | Q | R | S | T | V | W | Y |
| Y | 441 | A | C | D | E | F | G | H | I | K | L | M | N | P | Q | R | S | T | V | W | — |
| D | 443 | A | C | — | E | F | G | H | I | K | L | M | N | P | Q | R | S | T | V | W | Y |
| E | 478 | A | C | — | E | F | G | H | I | K | L | M | N | P | Q | R | S | T | V | W | Y |
| D | 498 | A | C | — | E | F | G | H | I | K | L | M | N | P | Q | R | S | T | V | W | Y |
| D | 549 | A | C | — | E | F | G | H | I | K | L | M | N | P | Q | R | S | T | V | W | Y |

Distinct combinations of any known envelopes/capsids/transgenes can further be used in a similar way to prepare retroviral vectors of the invention.

Example 2: Production Using Producer Cell Lines of HIV-1 Derived Retroviral Vectors which Cannot on their Own Achieve Complete Reverse Transcription ("Retroviral Vectors Deficient for Reverse Transcription")

HIV-1 derived vectors which cannot on their own achieve reverse transcription, also herein identified as reverse transcription deficient HIV-1 vectors, are produced by using stable producer cell lines. Such cell lines are generated by introducing into a single cell the required transcomplementation elements: envelope and capsid, including the pol gene (expression of which leads to the production of the reverse transcriptase) along with an HIV-1 vector genome (expression of which leads to the formation of a ribonucleic vector genome that can be encapsidated). These elements (envelop, capsid and ribonucleic vector genome) are stably introduced into a cell as one or more expression cassettes under the control of promoter(s) (constitutively active promoters or inducible promoters). When the elements are expressed altogether in the cell, they form vector particles, which are released by cells in the surrounding culture medium. These produced HIV-1 vector particles include RNA vector genome molecules and a mutant reverse transcriptase or no reverse transcriptase. These particles are collected from the cell culture medium and subsequently used for different purposes, in vitro or in vivo, as further detailed below.

Amino acid positions of the reverse transcriptase to be advantageously mutated in the context of the invention are determined by combining structural data, rational design, literature reports, phylogenetic alignment, combinatory libraries and random mutagenesis to determine the critical positions for polymerase and RNAseH activities of the reverse transcriptase.

In a first example, the stable producing cell lines contain the following sequences: SEQ ID NO:52, SEQ ID NO:53 and SEQ ID NO:54, and allow the production of vector particles characterized in that (1) they are enveloped with Mokola glycoprotein, (2) they contain an RNA molecule allowing the expression of neomycin phosphotransferase, and (3) they contain a reverse transcriptase with the D110E and E478Q substitutions, which is deficient for reverse transcription. This cell line is generated by transient transfection of HEK-293T cells with 3 plasmids containing the above-mentioned sequence. These cells are then treated with G418, puromycin and hygromycin, which allow the selection of cells stably incorporating the neo expression cassette brought by the vector plasmid, the puromycin resistance gene brought by the envelope transcomplementation plasmid and the hygromycin resistance gene brought by the capsid transcomplementation plasmid. Selected cells are seeded at a very low density to generate homogenous clonal populations. Clonal populations are then screened to identify cells that efficiently express all the required elements and allow the highest vector particle titre production.

In a second example, the stable producing cell lines contain the following sequences: SEQ ID NO:53, SEQ ID NO:55 and SEQ ID NO:56. The produced vector particles are then characterized in that (1) they are enveloped with VSV glycoprotein, (2) they contain an RNA molecule allowing the expression of neomycin phosphotransferase, and (3) they contain a reverse transcriptase with the D110E and E478Q substitutions which is deficient for reverse transcription. To avoid the toxicity of the constitutive expression of VSV glycoprotein for the cells, the VSV gene is placed under the control of a doxycycline inducible promoter. The VSV glycoprotein is then expressed when the cells are treated by a sufficient dose of doxycycline. In this particular embodiment, the treatment of cells by hygromycin, G418 and puromycin allows the selection of cells respectively containing the inducible transcomplementation cassette, the vector cassette and the transactivator cassette. The selection of the most efficient clones is then performed in a doxycycline-containing medium.

In a third example, the stable cell line allowing the production of HIV-1 vector particles pseudotyped with VSV, expressing the neo gene and containing a double mutant D110E and E478Q reverse transcriptase, does not contain the VSV-expressing cassette. Cells constitutively express the genome (from SEQ ID NO:53) and the encapsidation elements (from SEQ ID NO:54), including the mutant reverse transcriptase, leading to uncompleted and non-functional particles. The production of complete and functional particles is induced when the VSV is expressed in the cells. The VSV-expressing cassette is brought by transient transfection by calcium phosphate (SEQ ID NO:46) or lipofectamine. 48 hours after the transfection, HIV-1 vector particles are released from cells in the cell culture medium and are collected for further uses, in vitro and/or in vivo.

Distinct combinations of any known envelopes/capsids/transgenes can be used in a similar way to prepare retroviral vectors of the invention.

Producer cell lines of MLV-derived retroviral vectors, as well as any other retroviral vectors herein described, can also be prepared following example 2.

Example 3: Production by Transient Transfection of MLV-Derived Retroviral Vectors which Cannot on their Own Achieve Complete Reverse Transcription ("Retroviral Vectors Deficient for Reverse Transcription")

MLV-derived vectors, which cannot on their own achieve reverse transcription, also herein identified as reverse transcription deficient MLV vectors, are produced by transient transfection of 3 particular plasmids in producer cells (see FIG. 7). These three plasmids are (i) the vector plasmid, (ii) the transcomplementation envelope plasmid and (iii) the transcomplementation encapsidation plasmid containing a modified reverse transcriptase coding sequence or no reverse transcriptase, as described previously.

Briefly, the 3 plasmids are transfected by the calcium phosphate precipitation method into HEK-293T cells. The transfected cells then produce MLV vector particles including an RNA molecule and a mutant reverse transcriptase or no reverse transcriptase. These particles are recovered from the cell culture medium.

Amino acid positions of the reverse transcriptase to be advantageously mutated in the context of the invention are determined by combining structural data, rational design, literature reports, phylogenetic alignment, combinatory libraries and random mutagenesis to determine the critical positions for polymerase and RNAseH activities of the reverse transcriptase.

In a first example, SEQ ID NO:46, SEQ ID NO:57 and SEQ ID NO:58 are used. The produced vector particles are then characterized in that (1) they are enveloped with VSV glycoprotein, (2) they contain an RNA molecule allowing the expression of GFP, and (3) they contain a reverse transcriptase with a D150E substitution and cannot on their own achieve complete reverse transcription.

In a second example, SEQ ID NO:49, SEQ ID NO:59 and SEQ ID NO:60 are used. The produced vector particles are then characterized in that (1) they are enveloped with Mokola glycoprotein, (2) they contain an RNA molecule allowing the expression of LUC, and (3) they contain a reverse transcriptase with an E562Q substitution and cannot on their own achieve complete reverse transcription.

In a third example, SEQ ID NO:49, SEQ ID NO:59 and SEQ ID NO:63 are used. The produced vector particles are then characterized in that (1) they are enveloped with Mokola glycoprotein, (2) they contain an RNA molecule allowing the expression of LUC, and (3) they contain no reverse transcriptase and cannot on their own achieve complete reverse transcription.

In a fourth example, SEQ ID NO:49, SEQ ID NO:59 and SEQ ID NO:64 are used. The produced vector particles are then characterized in that (1) they are enveloped with Mokola glycoprotein, (2) they contain an RNA molecule allowing the expression of LUC, and (3) they contain no reverse transcriptase, no integrase and no protease and cannot on their own achieve complete reverse transcription.

MLV-derived retroviral vectors are similarly prepared using mutations described in Table 6 below.

HIV-1 derived vector particles are produced by transient transfection of HEK-293T cells with (i) the VSV envelope transcomplementation plasmid (SEQ ID NO:46), (ii) the capsid transcomplementation plasmid containing a mutated reverse transcriptase with a D110E substitution (SEQ ID NO:48) and (iii) the vector plasmid encoding GFP (SEQ ID NO:47). 10 µl of the vector particle preparation are contacted either with 400,000 HEK-293T cells, which were harvested 24 hours later, or with 100,000 293T cells, which were harvested 48 hours later. In each experiment, GFP expression is evaluated by FACS. Results are shown in FIGS. 8A and 8B and Table 7 below.

TABLE 6

Preferred critical positions identified in MLV reverse transcriptase sequence (SEQ ID NO: 36) and substitutions advantageously affecting the polymerase activity or the RNAseH activity.

| amino acid | position | mutation | | | | | | | | | | | | | | | | | | | |
|---|---|---|---|---|---|---|---|---|---|---|---|---|---|---|---|---|---|---|---|---|---|
| G | 85 | A | C | D | E | F | — | H | I | K | L | M | N | — | Q | R | S | T | V | W | Y |
| K | 103 | A | C | D | E | F | G | H | I | — | L | M | N | — | Q | R | S | T | V | W | Y |
| R | 110 | A | C | D | E | F | G | H | I | K | L | M | N | P | Q | — | S | T | V | W | Y |
| N | 119 | A | C | D | E | F | G | H | I | K | L | M | — | P | Q | — | S | T | V | W | Y |
| D | 150 | A | C | — | E | F | G | H | I | K | L | M | N | P | Q | R | S | T | V | W | Y |
| A | 154 | — | C | D | E | F | G | H | I | K | L | M | N | P | Q | — | S | T | V | W | Y |
| F | 170 | A | C | D | E | — | G | H | — | K | L | M | N | P | Q | R | S | T | — | W | Y |
| L | 188 | A | C | — | E | F | G | H | I | K | — | M | N | P | Q | R | S | T | V | W | Y |
| P | 189 | — | C | D | E | F | G | H | I | K | L | M | N | — | Q | R | S | T | V | W | Y |
| Q | 190 | A | C | D | E | F | G | H | I | K | L | M | N | P | — | R | S | T | V | W | — |
| G | 191 | A | C | D | E | — | — | H | I | K | L | M | N | P | Q | R | S | T | V | W | Y |
| S | 195 | A | C | D | E | F | G | H | I | K | L | M | N | — | Q | R | — | T | V | W | Y |
| Y | 222 | A | C | D | E | F | G | H | I | K | L | M | N | P | Q | R | S | T | V | W | — |
| D | 224 | A | C | — | E | F | G | H | I | K | L | M | N | P | Q | R | S | T | V | W | Y |
| D | 225 | A | C | — | E | F | G | H | I | K | L | M | N | P | Q | R | S | T | V | W | Y |
| G | 305 | A | C | D | E | — | — | H | I | K | — | M | N | P | Q | R | S | T | V | W | Y |
| F | 309 | A | C | D | E | — | G | H | — | K | L | M | N | P | Q | R | S | T | — | W | Y |
| L | 326 | A | C | D | E | F | G | H | — | K | — | M | N | P | Q | R | S | T | — | W | Y |
| A | 343 | — | — | — | — | F | — | — | — | — | — | — | — | P | — | — | — | — | — | W | Y |
| L | 359 | — | — | D | E | — | G | H | — | K | — | — | N | P | Q | R | S | — | — | W | Y |
| A | 423 | — | C | D | E | F | — | H | I | K | L | M | N | P | Q | R | — | T | V | W | Y |
| G | 429 | A | C | D | E | F | — | H | I | K | L | M | N | P | Q | R | S | T | V | W | Y |
| V | 470 | A | C | D | E | F | G | H | — | K | — | M | N | P | Q | R | S | T | — | W | Y |
| P | 487 | A | — | — | E | F | — | — | I | — | L | M | — | — | — | — | — | — | V | W | Y |
| Y | 522 | A | C | D | E | — | G | H | — | K | L | M | N | P | Q | R | S | T | V | — | — |
| D | 524 | A | C | — | E | F | G | H | I | K | L | M | N | P | Q | R | S | T | V | W | Y |
| E | 562 | A | C | D | — | F | G | H | I | K | L | M | N | P | Q | R | S | T | V | W | Y |
| D | 583 | A | C | — | E | F | G | H | I | K | L | M | N | P | Q | R | S | T | V | W | Y |
| G | 648 | A | C | D | E | F | — | H | I | K | L | M | N | P | Q | R | S | T | V | W | Y |

For each identified residue, the native amino acid is indicated as well as its position in the reference sequence and the possible substitutions. Any one or several of the identified residues can further be deleted or be concerned by a STOP mutation as herein defined.

Distinct combinations of any known envelopes/capsids/transgenes can be used in a similar way to prepare any retroviral vectors of the invention.

Example 4: GFP Expression Mediated In Vitro by Reverse Transcription Deficient Retroviral Vector Particles The below experiment is performed with HIV-1 and MLV-derived retroviral vectors (using mutations appearing in Tables 5 and 6 respectively) and is only detailed below for HIV-1 derived retroviral vectors comprising a mutated reverse transcriptase, the mutation affecting the polymerase domain and/or the RNAseH domain.

In the same way, HIV-1 derived vector particles are produced by transient transfection of HEK-293T cells with (i) the VSV envelope transcomplementation plasmid (SEQ ID NO:46), (ii) the capsid transcomplementation plasmid containing a mutated reverse transcriptase either with an E478Q substitution (SEQ ID NO:51) or with D110E and E478Q substitutions (SEQ ID NO:65) and (iii) the vector plasmid encoding the GFP (SEQ ID NO:47). The vector particle preparations are used to treat 293T cells (10 µL per 120,000 cells). Cells are harvested 48 hours after contact with the vectors and GFP expression is evaluated by FACS. Results are shown in FIGS. 8C and 8D and Table 7 below.

These results show that the reverse transcription deficient retroviral vector particles comprising the sequence encoding the GFP transgene allow the expression of GFP 24 and 48 hours after contact with target cells.

TABLE 7

Analyses of the percentage of GFP positive cells by FACS - see FIGS. 8 A-D.

| | Ungated | | Viable cells | |
|---|---|---|---|---|
| | % gated of viable cells | X-Mean of viable cells | % gated of GFP+ cells | X-Mean of GFP+ cells |
| A | 99.86 | 10.3 | 2.68 | 4.4 |
| B | 99.54 | 9.1 | 21.68 | 1.6 |
| C | 99.91 | 13.8 | 2.21 | 11.2 |
| D | 99.94 | 12.8 | 2.3 | 31 |

Example 5: Kinetic of GFP Expression Mediated In Vitro by Reverse Transcription Deficient Retroviral Vector Particles The below experiment is performed with HIV-1 and MLV-derived retroviral vectors (using mutations appearing in Tables 5 and 6 respectively) and is only detailed below for HIV-1 derived retroviral vectors comprising a mutated reverse transcriptase, the mutation affecting the polymerase domain and/or the RNAseH domain.

HIV-1 derived vector particles are produced by transient transfection of HEK-293T cells with (i) the VSV-envelope transcomplementation plasmid (SEQ ID NO:46), (ii) the capsid transcomplementation plasmid containing a mutated reverse transcriptase either with a D110E substitution (SEQ ID NO:48), or an E478Q substitution (SEQ ID NO:51), or the D110E and E478Q substitutions (SEQ ID NO:65) and (iii) the vector plasmid encoding the GFP (SEQ ID NO:47). The vector particles preparations are used to treat 293T cells (4 µL per 200,000 cells). Cells are harvested at different time points after transduction and proteins are extracted and submitted to Western blot analyses. Results are shown in FIGS. 9A to 9C.

These results show that the reverse transcription deficient particles comprising the sequence encoding the GFP transgene allow the transient expression of the transgene; expression is detectable as early as 4 hours after contact and disappears around 12 days (lane 11 of FIG. 9 A-C) after contact with the target cells with a maximum expression level between 3 and 5 days.

Example 6: Luciferase Expression Mediated In Vitro by Reverse Transcription Deficient Retroviral Vector Particles The below experiment is performed with HIV-1 and MLV-derived retroviral vectors (using mutations appearing in Tables 5 and 6 respectively) and is only detailed below for HIV-1 derived retroviral vectors comprising a mutated reverse transcriptase, the mutation affecting the polymerase domain and/or the RNAseH domain.

HIV-1 derived vector particles are produced by transient transfection of HEK-293T cells with (i) the VSV-envelope transcomplementation plasmid (SEQ ID NO:46), (ii) the capsid transcomplementation plasmid containing a mutated reverse transcriptase either with a D110E substitution (SEQ ID NO:48), an E478Q substitution (SEQ ID NO:51), or the D110E and E478Q substitutions (SEQ ID NO:65) and (iii) one of the following vector plasmids encoding the Luciferase: SEQ ID NO:66, SEQ ID NO:50, or SEQ ID NO:67. The vector particle preparations are contacted with HEK-293T cells (1, 3 and possibly 5 µL per 35,000 cells when cells are harvested 24 hours later, or per 20,000 cells when cells are harvested 48 hours later). Afterwards Luciferase expression is evaluated by enzymatic assay. Results are shown in FIGS. 10A to 10H.

These results show that the reverse transcription deficient retroviral vector particles comprising the sequence encoding the Luciferase transgene allow the expression of Luciferase 24 and 48 hours after contact with target cells in a dose-dependent manner.

Example 7: GFP Expression Mediated by HIV-1 Reverse Transcription Deficient Vector Particles in Vitro is Dependent on Particle Uncoating but Independent of Reverse Transcriptase Activity The below experiment is performed with HIV-1 and MLV-derived retroviral vectors (using mutations appearing in Tables 5 and 6 respectively) and is only detailed below for HIV-1 derived retroviral vectors comprising a mutated reverse transcriptase, the mutation affecting the polymerase domain and/or the RNAseH domain.

HIV-1 derived vector particles are produced by transient transfection of HEK-293T cells with (i) the VSV-envelope transcomplementation plasmid (SEQ ID NO:46), (ii) the capsid transcomplementation plasmid containing a mutated reverse transcriptase either with a D110E substitution (SEQ ID NO:48), an E478Q substitution (SEQ ID NO:51), or the D110E and E478Q substitutions (SEQ ID NO:65) and (iii) the vector plasmid encoding the GFP (SEQ ID NO:47). The vector particle preparations are contacted with HEK-293T cells (4 µL per 200,000 cells) in presence of 0.1 mM chloroquine, an inhibitor of endosome acidification (VSV pseudotyped retroviral vector particle uncoating pathway), or 10 µM azidothymidine, an inhibitor of HIV-1 reverse transcriptase. Cells are harvested 24 hours after transduction and proteins are extracted and submitted to Western blot analyses. Results are shown in FIG. 11.

These results show that the reverse transcription deficient particles comprising the sequence encoding the GFP transgene allow the expression of GFP 24 hours after contact with target cells and said expression is dependent on uncoating of the particle but not on reverse transcriptase activity. Measured GFP expression thus genuinely results from (i) a transduction mechanism and not from pseudo transduction or contamination of the vector, e.g., with plasmids originating from the production process and (ii) direct translation of the RNA genome and does not involve the reverse transcription of the RNA genome into a DNA provirus.

Example 8: In Vitro Evaluation of the Residual Integration Frequency of Neomycine Phosphotransferase Expressing Reverse Transcription Deficient Retroviral Vector Particles The below experiment is performed with HIV-1 and MLV-derived retroviral vectors (using mutations appearing in Tables 5 and 6, respectively) and is only detailed below for HIV-1 derived retroviral vectors comprising a mutated reverse transcriptase, the mutation affecting the polymerase domain and/or the RNAseH domain.

In order to evaluate the residual integration frequency of reverse transcription deficient retroviral vectors, HIV-1 derived vector particles are produced by transient transfection of HEK-293T cells with (i) the VSV-envelope transcomplementation plasmid (SEQ ID NO:46), (ii) the capsid transcomplementation plasmid containing a mutated reverse transcriptase either with a D110E substitution (SEQ ID NO:48), an E478Q substitution (SEQ ID NO:51), or the D110E and E478Q substitutions (SEQ ID NO:65) and (iii) the vector plasmid encoding the neomycin phosphotransferase (NEO) (SEQ ID NO:53).

Similar vectors including a wild-type reverse transcriptase (SEQ ID NO:68) are simultaneously produced. The vector particle preparations are contacted with HeLa cells (1 µL, 2.5 µL or 5 µL per 100,000 cells for the RT-deficient vectors; 0.1 µL, 0.25 µL or 0.5 µL per 100,000 cells for the RT-WT vector). Cells are then grown for 2 days in normal medium without G418. Half of the cells are collected for protein and RNA extraction. The remaining half of the cells are grown for an additional 12 days (mutated RT treated cells) or 6 days (RT-WT treated cells) in presence of G418. Cells are then fixed with paraformaldehyde and colored with trypan blue (see FIGS. 12I to 12III).

RNA and protein extracts collected 48 hours after contact with the particles are analysed respectively by RT-PCR and Western blot to visualize NEO expression. G418 resistant colonies grown after 14 or 8 days, indicating the stable integration of a NEO expression cassette, are observed. Results are shown in FIGS. 13A and 13B.

These results show that the reverse transcription deficient retroviral vector particles comprising the sequence encoding the NEO transgene allow the expression of NEO (detection of the RNA and of the protein) 48 hours after contact with target cells. The stable clones having undergone integration of the NEO encoding sequence are extremely rare for cells transduced with the reverse transcription deficient retroviral vector compared to the clones generated by treatment with reverse transcriptase proficient retroviral vectors, even when compared with vectors bearing a mutation in the integrase gene (non-integrating lentiviral vectors). Thus, the vectors of the invention have improved biosafety features, especially when relating to the risk of insertional mutagenesis.

Example 9: In Vitro Transient Expression of a DNA Modifying Enzyme (Cre Recombinase) by Reverse Transcription Deficient Retroviral Vector Particles The below experiment is performed with HIV-1 and MLV-derived retroviral vectors (using mutations appearing in Tables 5 and 6 respectively) and is only detailed below for HIV-1 derived retroviral vectors comprising a mutated reverse transcriptase, the mutation affecting the polymerase domain and/or the RNAseH domain.

In order to demonstrate the potential of reverse transcription deficient HIV-1 vectors to transiently express a recombinase in a way that it can induce recombination in cell, Cre-expressing vectors are produced by transient transfection of 293T cells with (i) the VSV-envelope transcomplementation plasmid (SEQ ID NO:46), (ii) the capsid transcomplementation plasmid containing a mutated reverse transcriptase with a D110E substitution (SEQ ID NO:48), and (iii) the vector plasmid encoding the Cre recombinase (SEQ ID NO:69). The produced vectors are used to transduce CV-1 5B reporter cells.

The CV-1 5B reporter cell line created by Kellendonk et al (Kellendonk C., Tronche F., Monaghan A. P., Angrand P. O., Stewart F., Schutz G., Nucleic Acids Res. 1996; 24:1404-1411) harbours a stable integration of the pHSVtk/loxNeolox/NLS-lacZ reporter construct. Expression of the NLS-lacZ gene is only detected in cells that have undergone Cre-mediated deletion of the loxP flanked neomycin phosphotransferase gene, as shown in FIG. 14I.

CV-1 5B cells are transduced with increasing doses of HIV-1 derived vectors which cannot on their own achieve complete reverse transcription (0 µL, 1 µL, 3 µL, 6 µL, 10 µL per 100,000 cells) and grown for 72 hours in 6-well plates. Cells are then fixed and LacZ expression is revealed by X-Gal assay. Results are shown in FIG. 14II.

These results show that the reverse transcription deficient particles comprising the sequence coding for the Cre recombinase allow the expression of Cre recombinase in a way that it can induce recombination of loxP sites in target cells.

Example 10: In Vitro Transient Expression of Various VEGF Isoforms (Both Pro-Angiogenic and Anti-Angiogenic Isoforms) by Reverse Transcription Deficient Retroviral Vector Particles The below experiment is performed with HIV-1 and MLV-derived retroviral vectors (using mutations appearing in Tables 5 and 6 respectively) and is only detailed below for HIV-1 derived retroviral vectors comprising a mutated reverse transcriptase, the mutation affecting the polymerase domain and/or the RNAseH domain.

In order to demonstrate the potential of reverse transcription deficient HIV-1 vectors to transiently express a VEGF for a therapeutic purpose, VEGF-expressing vectors are produced by transient transfection of HEK-293T cells with (i) the VSV-envelope transcomplementation plasmid (SEQ ID NO:46), (ii) the capsid transcomplementation plasmid containing a mutated reverse transcriptase either with a D110E substitution (SEQ ID NO:48), an E478Q substitution (SEQ ID NO:51), or the D110E and E478Q substitutions (SEQ ID NO:65) and (iii) the vector plasmid encoding either an optimized sequence of VEGF 165a (SEQ ID NO:70 or SEQ ID NO:71), an optimized sequence of VEGF 165b (SEQ ID NO:72), or an optimized sequence of VEGF 121 (SEQ ID NO:73). The produced vectors are used to transduce HEK-293T cells with several doses (2 µL at 15 µL per 35,000 cells). In some cases, to verify that the transduction observed does not result from reverse transcribed vector genomes, cells are transduced in the presence of azidothymidine, an inhibitor of HIV-1 reverse transcriptase. Cells are grown for 60 hours after contact with the vector and VEGF is measured in the cell culture medium and/or in cell lysates. Results are shown in FIGS. 15I to 15V.

These results show that the reverse transcription deficient retroviral vector particles comprising the sequence coding a particular VEGF isoform allow the expression of said VEGF isoform after contact with target cells. Said VEGF may be used for therapeutic purposes, for example, to promote angiogenesis (VEGF 165a and VEGF 121a) or to prevent angiogenesis (VEGF 165b). These results also show that the measured VEGF expression thus genuinely results from (i) a transduction mechanism and not from pseudo transduction or contamination of the vector, e.g., with plasmids originating from the production process and (ii) direct translation of the RNA genome and does not involve the reverse transcription of the RNA genome into a DNA provirus.

Example 11: In Vitro Transient Expression of DNA-Modifying Enzymes (GFP-Targeting Zinc Finger Nucleases) by Reverse Transcription Deficient Retroviral Vector Particles The below experiment is performed with HIV-1 and MLV-derived retroviral vectors (using mutations appearing in Tables 5 and 6 respectively) and is only detailed below for HIV-1 derived retroviral vectors comprising a mutated reverse transcriptase, the mutation affecting the polymerase domain and/or the RNAseH domain.

In the present example, vectors of the invention are used to transiently express Zinc Finger Nucleases in order to induce a double-stranded break at a precise target sequence in the host target genome giving rise to mutation(s) in said target sequence by cut and repair mechanisms (through non-homologous end joining (NHEJ)).

The used Zinc Finger Nuclease (consisting of two sub-units, zGFP-3 and zGFP-4, which assemble to form a functional GFP-ZFN) targets a motif in the GFP coding sequence, generates a double-stranded break (see FIG. 16). This double-stranded break will induce the cell's NHEJ repair mechanism (often inducing a frame shift in the open reading frame).

Optimized sequences coding each one of the two units required to form the functional ZFN are placed in two separated plasmids, which are used to produce vectors by transient transfection.

Vector A is produced by transient transfection of HEK-293T cells with (i) the VSV-envelope transcomplementation plasmid (SEQ ID NO:46), (ii) the capsid transcomplementation plasmid containing a mutated reverse transcriptase with a D110E substitution (SEQ ID NO:48) and (iii) the vector plasmid encoding an optimized sequence of zGFP-3 (SEQ ID NO:74).

Vector B is produced by transient transfection of HEK-293T cells with (i) the VSV-envelope transcomplementation plasmid (SEQ ID NO:46), (ii) the capsid transcomplementation plasmid containing a mutated reverse transcriptase with a D110E substitution SEQ ID NO:48) and (iii) the vector plasmid encoding an optimized sequence of zGFP-4 (SEQ ID NO:75).

To evaluate the efficiency of the obtained vectors, we generated the HeLa H11 cell line containing a GFP expression cassette stably integrated in its chromosomes (and constitutively active). HeLa H11 cells were transduced by vectors A (RT-D110E ZNF-3) and B (RT-D110E ZNF-4), respectively expressing zGFP-3 and zGFP-4 (10 µL each per 3,000 cells). Cells were grown for 22 days and GFP expression was analysed by FACS to measure the efficacy of GFP extinction induced by transient ZFN expression. Results are presented in FIG. 17I.

To confirm the GFP extinction observed by FACS in the HeLa H11 cells after treatment with vector A and vector B, cells are collected, DNA is extracted and GFP locus is amplified by PCR. Amplification is performed using (i) primers located in 5' and 3' from the ZFN target site and (ii) a high-fidelity DNA polymerase (Taq Phusion, Finnzymes).

In a first assay, these PCR fragments are boiled and slowly annealed. After annealing, fragments are submitted to treatment by surveyor nuclease (Surveyor mutation detection kit, Transgenomic), which specifically cuts DNA fragments containing mismatches. As a consequence, if the PCR product is homogenous, the nuclease treatment will not induce any cuts; in contrast, if the PCR products contain different forms of GFP, the annealing will generate heteroduplexes with mismatches on the ZFN target site which are sensitive to nuclease. The nuclease treatment will thus generate several fragments of approximately 185 and 420 nucleotides. The results of the nuclease treatment are presented in FIG. 17II.

In a second assay, these PCR fragments are subcloned in pGEMT easy plasmid (Clontech) and analysed by sequencing. Out of 20 clones analysed from the ZFN treated population, 3 clones contain a mutation in the ZFN target site (control sequence: SEQ ID NO:76, mutant sequences: SEQ ID NO:77, SEQ ID NO:78 and SEQ ID NO:79—see FIG. 17III, page 20/20). In contrast, the 23 clones analysed from the control non-transduced cells contain a wild-type non-mutated ZFN target site.

These results show that the reverse transcription deficient retroviral vector particles comprising the sequence coding for a Zinc Finger Nuclease allow the expression of said ZFN in a way that it can induce a double-stranded break in the targeted locus and consequent knockout/null mutation of said locus by NHEJ repair mechanisms.

Example 12: Transient Expression of DNA-Modifying Enzymes (p53 Targeting Zinc Finger Nucleases) by Reverse Transcription Deficient HIV-1 Vector Particles In Vitro The used Zinc Finger Nuclease (consisting in two sub-units, ZFN p53 L and ZFN p53 R, which assemble to form a functional p53-ZFN) targets a motif in the p53 coding sequence, generating a double-stranded break. Optimized sequences coding each one of the two units required to form the functional ZFN are placed in two separated plasmids, which are used to produce vectors by transient transfection.

Vector A is produced by transient transfection of HEK-293T cells with (i) the VSV-envelope transcomplementation plasmid (SEQ ID NO:46), (ii) the capsid transcomplementation plasmid containing a mutated reverse transcriptase with a D110E substitution (SEQ ID NO:48) and (iii) the vector plasmid encoding an optimized sequence of ZFN p53 L (SEQ ID NO:80).

Vector B is produced by transient transfection of HEK-293T cells with (i) the VSV-envelope transcomplementation plasmid (SEQ ID NO:46), (ii) the capsid transcomplementation plasmid containing a mutated reverse transcriptase with a D110E substitution (SEQ ID NO:48) and (iii) the vector plasmid encoding an optimized sequence of ZFN p53 R (SEQ ID NO:81).

Example 13: Encapsidation of the Retroviral RNA Genome and Luciferase Expression Mediated in Vitro by Reverse Transcription Deficient Retroviral Vector Particles The below experiment is performed with HIV-1 derived retroviral vectors produced with modifications of the pol gene, i.e., comprising a mutated reverse transcriptase sequence, said mutations affecting the polymerase domain and/or the RNAseH domain, or comprising a deletion in the pol gene, more specifically in the reverse transcriptase region, spanning the reverse transcriptase and integrase regions, or spanning the reverse transcriptase, integrase and protease regions (see FIG. 20).

HIV-1 derived vector particles are produced by transient transfection of HEK-293T cells with (i) the VSV-envelope transcomplementation plasmid (SEQ ID NO:46), (ii) the capsid transcomplementation plasmid containing a modified pol gene: either a reverse transcriptase with a D110E substitution (SEQ ID NO:48), a pol gene with a 90 base pair deletion (RT-Δ90, SEQ ID NO:95), a 787 base pair deletion (RT-Δ787, SEQ ID NO:96), an 877 base pair deletion (RT-Δ877, SEQ ID NO:97), a 2524 base pair deletion (RT-Δ2524, SEQ ID NO:98), or a 2712 base pair deletion (RT-Δ2712, SEQ ID NO:99) and (iii) the vector plasmid encoding the Luciferase (SEQ ID NO:66).

Vector particle preparations are first assayed for encapsidation of the RNA genome. RNA is extracted and submitted to in vitro reverse transcription using SuperScriptII (Invitrogen) and primers located in the 5' LTR and in the psi region. Results of a representative experiment are presented in Table 8 below.

These results indicate that the retroviral particles that are generated properly encapsidate the RNA vector genome when the transcomplementation cassette used contains either a modified RT region or no RT region. However, when the encapsidation cassette used contains further modifications of the pol region, i.e., affecting in addition to the RT region the integrase region and the protease region, the generated particles are not suitable to carry the retroviral RNA genome. Deletion of the pol gene larger than the RT region affects the encapsidation of the RNA vector genome.

TABLE 8

Modification of the pol gene and encapsidation of the retroviral genome

| Vector | pol modification | RNA encapsidation (genome/μL) |
|---|---|---|
| RT-D110E | Substitution in the reverse transcriptase coding region | $2.41 \times 10^7$ |
| RT-Δ90 | Deletion of 90 bp in the reverse transcriptase coding region | $2.57 \times 10^7$ |
| RT-Δ787 | Deletion of 787 bp in the reverse transcriptase coding region | $1.18 \times 10^7$ |
| RT-Δ877 | Deletion of 877 bp in the reverse transcriptase coding region | $1.47 \times 10^7$ |
| RT-Δ2524 | Deletion of 2524 bp spanning the reverse transcriptase and the integrase coding regions | $9.60 \times 10^4$ |
| RT-Δ2712 | Deletion of 2712 bp spanning the reverse transcriptase, the integrase and the protease coding regions | $1.09 \times 10^5$ |

In another experiment, transgene expression level mediated by these retroviral particles has been assayed. The vector particle preparations are contacted with HEK-293T cells (1, 3 and 5 μL per 20,000 cells) which are harvested 48 hours later. Afterwards Luciferase expression is evaluated by enzymatic assay. Results are shown in FIG. 18.

These results show that the reverse transcription deficient retroviral vector particles allow the expression of Luciferase in target cells, as long as they have properly encapsidated a retroviral RNA genome molecule comprising the sequence encoding the Luciferase transgene.

These results taken together and summarized in Table 9 below show that although the reverse transcriptase region can be modified by either substitution or deletion, the integrase and protease regions should not simultaneously be modified by deletion without dramatically affecting the efficiency of the vectors of the invention: the encapsidation efficiency of the RNA genome is decreased as well as the transgene expression level, which is not significantly different from the background level (Luciferase activity in untransduced cells) and will not allow any therapeutic or functional effect.

TABLE 9

Correlation between the modifications of the pol gene, the encapsidation of the retroviral genome and the level of transgene expression

| Vector | pol modification | RNA encapsidation (genome/μL) | Transgene expression level |
|---|---|---|---|
| RT-D110E | Substitution in the reverse transcriptase coding region | +++ | +++ |
| RT-Δ90 | Deletion of 90 bp in the reverse transcriptase coding region | +++ | ++ |
| RT-Δ787 | Deletion of 787 bp in the reverse transcriptase coding region | ++ | ++ |
| RT-Δ877 | Deletion of 877 bp in the reverse transcriptase coding region | ++ | + |
| RT-Δ2524 | Deletion of 2524 bp spanning the reverse transcriptase and the integrase coding regions | Background level | Background level |
| RT-Δ2712 | Deletion of 2712 bp spanning the reverse transcriptase, the integrase and the protease coding regions | Background level | Background level |

Example 14: Indirect In Vitro Comparison of the Reverse Transcription Efficiency Through Evaluation of Integration Frequency of Neomycin Phosphotransferase Expressing Reverse Transcription Deficient Retroviral Vector Particles The below experiment is performed with HIV-1 derived retroviral vectors including a control wild-type vector (WT), a control integrase-mutant vector (D64V), reverse transcriptase-mutant vectors, the mutation affecting the polymerase domain and/or the RNAseH domain of the reverse transcriptase, and a PBS mutant vector.

The formation of G418 resistant clones involves the stable expression of the NeoR transgene which results from integration of the reverse transcribed provirus. Thus, measuring the number of G418 resistant clones provides quantitative information of the reverse transcription activity of the assayed vectors.

In order to evaluate the reverse transcription efficiency of the vectors of the invention, their integration frequency was evaluated and compared to control wild-type vectors. Non-integrative vectors (integrase mutant) as well as PBS mutant vectors were also studied for comparison.

For this experiment, HIV-1 derived vector particles are produced by transient transfection of HEK-293T cells with (i) the VSV-envelope transcomplementation plasmid (SEQ ID NO:46), (ii) the capsid transcomplementation plasmid containing a mutated reverse transcriptase either with a D110E substitution (SEQ ID NO:48), an E478Q substitution (SEQ ID NO:51), the D110E and E478Q substitutions (SEQ ID NO:65), the transcomplementation plasmid containing a mutated integrase (ESQ ID: 101), or a transcomplementation capsid containing a wild-type integrase and a wild-type reverse transcriptase (SEQ ID NO 68) and (iii) the vector plasmid encoding the neomycin phosphotransferase (NEO) (SEQ ID NO:53). In addition, HIV-1 derived vector particles with a mutation affecting the PBS are produced by transient transfection of HEK-293T cells with (i) the VSV-envelope transcomplementation plasmid (SEQ ID NO:46), (ii) the capsid transcomplementation plasmid (SEQ ID NO:68), and (iii) the vector plasmid containing the neomycin phosphotransferase gene and a mutation affecting the PBS (ΔPBS, SEQ ID NO: 100).

The vector particle preparations are contacted with HeLa cells (between 0.05 ng and 205 ng of p24 per 50,000 cells). Cells are then grown for 1 day in normal medium, then with 1.5 mg/ml of G418 for 8 days for the WT and D64V vectors, 10 days for the ΔPBS vector and 15 days for the RT-D110E and RT-E478Q vectors. Cells are then fixed with paraformaldehyde and stained with trypan blue. Pictures of each well are taken and analysed with Image-J software to determine relative cell density, revealing the integration frequency of the vector for each dose, as an indicator of the reverse transcription efficiency of the studied vectors. For each condition, 3 wells are evaluated and results are presented as a mean of these 3 values, +/− standard deviation (see FIG. 19).

These results show that the reverse transcriptase mutant vectors of the invention do not display any background activity of integration as no clones were observed in the corresponding wells. Thus these vectors do not display any residual reverse transcription activity. The absence of integration events revealed by this neo assay indicates that the vectors of the invention are fully deficient for reverse transcription.

As a comparison, integrase deficient retroviral vectors were included in this assay. In line with what has been described previously, integrase mutant vectors have an integration frequency reduced by approximately 100-fold as compared to a wild-type control vector.

As a comparison, PBS mutant retroviral vectors have an integration frequency similar to that of the integrase deficient vector, i.e., approximately $1/100$ of the integration activity of a wild-type control vector. This result indicates that the PBS deletion only poorly affects reverse transcription and PBS mutant vectors generate a large amount of DNA molecules which retain ability to integrate into the host cell chromatin, as previously shown.

Thus, the vectors of the invention have dramatically improved biosafety features, especially when regarding the risk of insertional mutagenesis, compared to PBS mutant vectors and integrase mutant vectors.

SEQUENCE LISTING (101 sequences)

SEQ ID NO: 1 - protein, 560 aa, Human immunodeficiency virus
PISPIETVPVKLKPGMDGPKVKQWPLTEEKIKALVEICTEMEKEGKISKIGPENPYNTPVFAIKKKDSTKWRKLVDFRELNKRTQDFWEVQLGIPHPAGLKQKKSVTVLDVGDAYFSVPLDKDFRKYTAFTIPSINNETPGIRYQYNVLPQGWKGSPAIFQCSMTKILEPFRKQNPDIVIYQYMDDLYVGSDLEIGQHRTKIEELRQHLLRWGFTTPDKKHQKEPPFLWMGYELHPDKWTVQPIVLPEKDSWTVNDIQKLVGKLNWASQIYAGIKVRQLCKLLRGTKALTEVVPLTEEAELELAENREILKEPVHGVYYDPSKDLIAEIQKQGQGQWTYQIYQEPFKNLKTGKYARMKGAHTNDVKQLTEAVQKIATESIVIWGKTPKFKLPIQKETWEAWWTEYWQATWIPEWEFVNTPPLVKLWYQLEKEPIIGAETFYVDGAANRETKLGKAGYVTDRGRQKVVPLTDTTNQKTELQAIHLALQDSGLEVNIVTDSQYALGIIQAQPDKSESELVSQIIEQLIKKEKVYLAWVPAHKGIGGNEQVDGLVSAGIRKVL

SEQ ID NO: 2 - protein, 560 aa, Human immunodeficiency virus
PISPIETVPVKLKPGMDGPKVKQWLLTEEKIKALTAICDEMEREGKITKIGPENPYNTPVFAIKKKDSTKWRKLVDFRELNKRTWDFWEVQLGIPHPAGLKKKKSVTVLDVGDAYFSVPLDEGFRKYTAFTIPSINNETPGIRYQYNVLPQGWKGSPSIFQSSTTKILEPFRAQNPEIIIYQYMDDLYVGSDLEIGQHRAKIEELREHLLKWGFTTPDKKHQKEPPFLWMGYELHPDKWTVQPIQLPEKDSWTVNDIQKLVGKLNWASQIYPGIKVRQLCKLLRGAKALTDIVPLTEEAELELAENREILKEPVHGVYYDPSKDLIAEIQKQGQNQWTYQIYQEPFKNLKTGKYAKMRTAHTNDVRQLTEAVQKIALESIIIWGKTPKFRLPIQKETWEAWWTDYWQATWIPEWEFVNTPPLVKLWYQLEKEPIAGAETFYVDGAANREIKMGKAGYVTDRGRQKIVSITETTNQKTELQAIQLALQDSGSEVNIVTDSQYALGIIQAQPDKSESELVNQIIEQLIKKERVYLSWVPAHKGIGGNEQVDKLVSSGIRKVL

SEQ ID NO: 3 - protein, 560 aa, Human immunodeficiency virus
PISPIETVPVKLKPGMDGPKVKQWPLTEEKIKALTEICMEMEKEGKISKIGPENPYNTPVFAIKKKDSTKWRKLVDFRELNKRTQDFWEVQLGIPHPAGLKKKKSVTVLDVGDAYFSVPLDKDFRKYTASTIPSTNNETPGVRYQYNVLPQGWKGSPAIFQYSMTKILDPFRAKNPDIVIYQYMDDLYVGSDLEIGQHRTKIEELREHLLKWGLTTPDKKHQKEPPFLWMGYELHPDKWTVQPIQLPDKDSWTVNDIQKLVGKLNWASQIYPGIKVKQLCKLLRGAKALTDIVPLTTEAELELAENREILKEPVHGAYYDPSKDLIAEIQKQGQGQWTYQIYQEPFKNLKTGKYAKMRSAHTNDVKQLTEAVQKISLESIVIWGKTPKFRLPILKETWDTWWTEYWQATWIPEWEFVNTPPLVKLWYQLETEPIVGAETFYVDGASNRETKKGKAGYVTDRGRQKAVSLTETTNQKAELQAIQLALQDSGSEVNIVTDSQYALGIIQAQPDKSESELVNQIIEQLIKKEKVYLSWVPAHKGIGGNEQVDKLVSAGIRKVL

SEQ ID NO: 4 - protein, 560 aa, Human immunodeficiency virus
PISPIETVPVKLKPGMDGPKVKQWPLTEEKIKALTEICTEMEKEGKISKIGPENPYNTPVFAIKKKDSTKWRKLVDFRELNKRTQDFWEVQLGIPHPAGLKKKKSVTVLDVGDAYFSVPLDKDFRKYTAFTIPSINNETPGVRYQYNVLPQGWKGSPAIFQHSMTKILEPFRIKNPEMVIYQYMDDLYVGSDLEIGQPRTKIEELREHLLKWGFTTPDKKHQKEPPFLWMGYELHPDKWTVQPIQLPDKDSWTVNDIQKLVGKLNWASQIYPGIKVKQLCKLLRGVKALTDIVPLTAEAELELAENREILKEPVHGVYYDPSKDLIAEIQKQGNDQWTYQIYQEPHKNLKTGKYARMRSAHTNDVKQLTEAVQKIATEGIVIWGKTPKFRLPIQKETWETWWTEYWQATWIPEWEFVNTPPLVKLWYQLETEPIVGAETFYVDGAAHRETKKGRAGYVTDRGRQKVVSITETTNQKAELQAICLALQDSGSEVNIVTDSQYALGIIQAQPDKSESDLVNQIIEQLIKKERIYLSWVPAHKGIGGNEQVDKLVSAGIRKVL

SEQ ID NO: 5 - protein, 560 aa, Human immunodeficiency virus
PISPIETVPVKLKPGMDGPKVKQWPLTEEKIKALVEICTEMEKEGKISKIGPENPYNTPVFAIKKKDSTKWIKLVDFRELNKRTPDFWEVQLGIPHPAGLKKKKSVTVLDVGDAYFSVPLDKDFRKYTAFTIPSINNETPGIRYQYNVLPQGWKGSPAIFQCSMTKILEPFRRKNPDMVLYQYMDDLYVGSDLEIGQHRAKIEELREHLLRWGFTTPDKKHQKEPPFLWMGYELHPDKWTVQPIQLPDKDSWTVNDIQKLVGKLNWASQIFPGIKVKQLCKLLRGVKALTDIVPLTAEAELELAENREILKEPVHGVYYDPSKDLIAEIQKQGHGQWTYQIYQEPYKNLKTGKYARIRSAHTNDVKQLTEVVQKVAMESIVIWGKTPKFRLPIQKETWGTWWTEYWQATWIPEWEFVNTPPLVKLWYQLETEPIVGAETFYVDGAANRETKQGKAGYVTDKGRQKVISITETTNQKTELQAIHLALQDSGSEVNIVTDSQYALGIIQAQPDKSESELVNQIIEQLIKKDRVYLSWVPAHKGIGGNEQVDKLVSSGIRKVL

SEQ ID NO: 6 - protein, 560 aa, Human immunodeficiency virus
PISPIETVPVKLKPGMDGPRVKQWPLTEEKIKALTEICKDMEKEGKISKIGPENPYNTPIFAIKKKDSTKWRKLVDFRELNKRTQDFWEVQLGIPHPAGLKKKRSVTVLDVGDAYFSVPLDKDFRKYTAFTIPSINNETPGIRYQYNVLPQGWKGSPAIFQSSMTKILEPSRTKNPEMVIYQYMDDLYVGSDLEIGQHRAKIEELREHLLKWGLTTPDKKHQKEPPFLWMGYELHPDKWTVQPIQLPEKEDWTVNDIQKLVGKLNWASQIYPGIKVKHLCRLLRGAKALTDIVPLTAEAEMELAENREILKEPVHGVYHDPSKELIAEVQKQGPDQWTYQIYQEPYKNLKTGKYAKRGSAHTNDVKQLTEVVQKIATEGIVIWGKIPKFKLPIRKETWEVWWTEYWQAAWIPEWEFVNTPPLVKLWYQLETEPIPGAETYYVDGAANRETKLGKAGHVTDKGKQKIITLTETTNQKAELHAIQLALQDSRPEVNIVTDSQYALGIIQAQPDRSGSELVNQIIEQLIKKEKVYLSWVPAHKGIGGNEQVDKLVSSGIRKVL

SEQ ID NO: 7 - protein, 560 aa, Human immunodeficiency virus
PISPIETVPVKLKPGMDGPKVKQWPLTEEKIKALVEICTEMEKEGKISKIGPENPYNTPVFAIKKKDSTKWRKLVDFRELNKRTQDFWEVQLGIPHPAGLKKKKSVTVLDVGDAYFSVPLDKDFRKYTAFTIPSINNETPGIRYQYNVLPQGWKGSPAIFQSSMTKILEPFRKQNPDIVIYQYMDDLYVGSDLEIGQHRTKIEELRQHLLRWGFTTPDKKHQKEPPFLWMGYELHPDKWTVQPIMLPEKDSWTVNDIQKLVGKLNWASQIYAGIKVKQLCKLLRGTKALTEVIPLTEEAELELAENREILKEPVHEVYYDPSKDLVAEIQKQGQGQWTYQIYQEPFKNLKTGKYARMRGAHTNDVKQLTEAVQKVSTESIVIWGKIPKFKLPIQKETWEAWWMEYWQATWIPEWEFVNTPPLVKLWYQLEKEPIVGAETFYVDGAANRETKLGKAGYVTDRGRQKVVSIADTTNQKTELQAIHLALQDSGLEVNIVTDSQYALGIIQAQPDKSESELVSQIIEQLIKKEKVYLAWVPAHKGIGGNEQVDKLVSAGIRKVL

SEQ ID NO: 8 - protein, 560 aa, Human immunodeficiency virus
PISPIAPVPVKLKPGMDGPKVKQWPLSKEKIEALTAICQEMEQEGKISRIGPENPYNTPIFAIKKKDGTKWRKLVDFRELNKRTQEFWEVQLGIPHPGGLKQKQSVTVLDVGDAYFSCPLDPDFRKYTAFTIPSVNNETPGIRYQYNVLPQGWKGSPAIFQSSMTKILDPFRRDNPELEICQYMDDLYVGSDLPLTEHRKRIELLREHLYQWGFTTPDKKHQKEPPFLWMGYELHPDKWTVQSIQLPNKDVWTVNDIQKLIGKLNWASQIYQGIRVRELCKLIRGTKSLTEVVPLSREAELELEENRERLKQPVHGVYYQPDKDLWVNIQKQGGEQWTYQIYQEEHKNLKTGKYTRQKASHTNDIRQLAEVIQKVSQESIIIWGKLPKFKLPVTRETWETWWADYWQATWIPEWEFVSTPPLIKLWYRLESEPIMGAETYYVDGAANRETKLGKAGYVTEQGKQKIIKLDETTNQKAELMAILLALQDSKETVNIVTDSQYALGVISSQPTQSESPIVQQIIEELTKKEQVYLTWVPAHKGIGGNEKIDKLVSKDIRRVL

SEQ ID NO: 9 - protein, 560 aa, Human immunodeficiency virus [sequence omitted]

SEQ ID NO: 10 - protein, 560 aa, Human immunodeficiency virus
PISPIETVPVKLKPGMDGPKVKQWPLTEEKIKALVEICTEMEKEGKISKIGPENPYNTPVFAIKKKDSTKWRKLVDFRELNRRTQDFWEVQLGIPHPAGLKKKKSVTVLDVGDAYFSVPLDEDFRKYTAFTIPSINNETPGSGYQYNVLPQGWKGSPAIFQSSMTKILEPFRKQNPDIVIYQYMDDLYVGSDLEIGQHRTKIEELRQHLLRWGFTTPDKKHQKEPPFLWMGYELHPDKWTIQPIVLPEKDSWTVNDIQKLVGKLNWASQIYPGIKVRQLCKLLRGTKALTEVIPLTEEAELELAENREILKEPVHGVYYDPSKDLIAEIQKQGQGQWTYQIYQEPFKNLKTGKYARMRGAHTNDVKQLTEAVQKITTESIVIWGKTPKFKLPIQKETWETWWTEYWQATWIPEWEFVNTPPLVKLWYQLEKEPIVGAETFYVDGAASRETKLGKAGYVTNRGRQKVVTLTHTTNQKTELQAIHLALQDSGLEVNIVTDSQYALGIIQAQPDKSESELVNQIIEQLIKKEKVYLAWVPAHKGIGGNEQVDKLVSAGIRKIL

SEQ ID NO: 11 - protein, 560 aa, Human immunodeficiency virus
PISPIETVPVKLKPGMDGPKVKQWPLTEEKIKALVEICTEMEKEGKISKIGPENPYNTPVFAIKKKDSTKWRKLVDFRELNKRTQDFWEVQLGIPHPAGLKKKKSVTVLDVGDAYFSVPLDEDFRKYTAFTIPSINNETPGIRYQYNVLPQGWKGSPAIFQSSMTKILEPFRKQNPDIVIYQYMDDLYVGSDLEIGQHRAKIEDLRQHLLKWGFTTPDKKHQKEPPFLWMGYELHPDKWTVQPIVLPEKDSWTVNDIQKLVGKLNWASQIYAGIKVKQLCKLLRGTKALTEVVPLTEEAELELAENREILKEPVHGVYYDPTKDLIAELQKQGQGQWTYQIYQEPYKNLKTGKYARMRGAHTNDVKQLTEAVQKIATESIVIWGKTPKFKLPIQKETWEAWWTDYWQATWIPEWEFVNTPPLVKLWYQLEKEPIVGAETFYVDGAANRDTKSGKAGYVTDRGRQKVVSLADTTNQKTELQAIHLALQDSGLEVNIVTDSQYALGIIQAQPDKSESELVSQIIEQLIKKEKVYLAWVPAHKGIGGNEQVDKLVSAGIRKVL

SEQ ID NO: 12 - protein, 560 aa, Human immunodeficiency virus
PISPIETVPVKLKPGMDGPKVKQWPLTEEKIKALVEICTEMEKEGKISKIGPENPYNTPVFAIKKKDSTKWRKLVDFRELNKRTQDFWEVQLGIPHPAGLKKKKSVTVLDVGDAYFSVPLDEDFRKYTAFTIPSINNETPGIRYQYNVLPQGWKGSPAIFQSSMTKILEPFRKQNPDIVIYQYMDDLYVGSDLEIGQHRTKIEELRQHLLRWGLTTPDKKHQKEPPFLWMGYELHPDKWTVQPIVLPEKDSWTVNDIQKLVGKLNWASQIYPGIKVRQLCKLLRGTKALTEVIPLTEEAELELAENREILKEPVHGVYYDPSKDLIAEIQKQGQGQWTYQIYQEPFKNLKTGKYARTRGAHTNDVKQLTEAVQKITTESIVIWGKTPKFKLPIQKETWETWWTEYWQATWIPEWEFVNTPPLVKLWYQLEKEPIVGAETFYVDGAASRETKLGKAGYVTNRGRQKVVTLTDTTNQKTELQAIHLALQDSGLEVNIVTDSQYALGIIQAQPDKSESELVNQIIEQLIKKEKVYLAWVPAHKGIGGNEQVDKLVSAGIRKVL

SEQ ID NO: 13 - protein, 560 aa, Human immunodeficiency virus
PISPIETVPVKLKPGMDGPKVKQWPLTEEKIKALTEICTDMEKEGKISRIGPENPYNTPIFAIKKKDSTKWRKLVDFRELNKRTQDFWEVQLGIPHPAGLKKKKSVTVLDVGDAYFSVPLDEDFRKYTAFTISSINNETPGIRYQYNVLPQGWKGSPAIFQSSMTKILEPFRKQNPEMVIYQYMDDLYVGSDLEIGQHRTKIEKLREHLLRWGFTRPDKKHQKEPPFLWMGYELHPDKWTVQSIKLPEKESWTVNDIQNLVERLNWASQIYPGIKVRQLCKLLRGTKALTEVIPLTEEAELELAENREILKEPVHGVYYDPSKDLIAEIQKQGHGQWTYQIYQEPFKNLKTGKYARMRGAHTNDVKQLAEAVQRISTESIVIWGRTPKFRLPIQKETWETWWAEYWQATWIPEWEFVNTPPLVKLWYQLEKEPIIGAETFYVDGAANRETKLGKAGYVTDRGRQKVVPLTDTTNQKTELQAINLALQDSGLEVNIVTDSQYALGIIQAQPDKSESELVNQIIEQLIKKEKVYLAWVPAHKGIGGNEQVDKLVSQGIRKVL

SEQ ID NO: 14 - protein, 560 aa, Human immunodeficiency virus
PISPIETVPVKLKPGMDGPKVKQWPLTEEKIKALTAICEEMEQEGKISRIGPENPYNTPVFAIKKKDSTKWRKLVDFRELNKRTQDFWEVQLGIPHPAGLKKKKSVTVLDVGDAYFSVPLDEGFRKYTAFTIPSTNNETPGIRYQYNVLPQGWKGSPPIFQSSMPQILEPFRAPNPEIVIYQYMDDLYVGSDLEIGQHRAPIEELREHLLKWGFTTPDKKHQKEPPFLWMGYELHPDKWTVQPIQLPEKDSWTVNDIQKLVGKLNWASQIYPGIKVRQLCKLLRGAKALTDIVTLTEEAELELAENREILKEPVHGVFYDPSKDLIAEIQKQGNDQWTFQFYQEPFKNLKTGKFAKRGTAHTNDVKQLTAVVQKIALESIVIWGKTPKFRLPIQKETWEAWWTDYWQATWIPEWEFVNTPPLVKLWYQLEKEPIAGVETFYVDGAANRETKIGKAGYVTDRGRQKIVSLTETTNQKTELQAIQLALQDSGSEVNIVTDSQYALGIILAQPDKSESEIVNQIIEQLISKERVYLSWVPAHKGIGGNEQVDKLVSSGIRKVL

SEQ ID NO: 15 - protein, 560 aa, Human immunodeficiency virus
PISPIETVPVKLKPGMDGPKVKQWPLTEEKIKALVEICTEMEKEGKISKIGPENPYNTPVFAIKKKDSTKWRKLVDFRELNKRTQDFWEVQLGIPHPAGLKKKKSVTVLDVGDAYFSVPLDEDFRKYTAFTIPSINNETPGIRYQYNVLPQGWKGSPAIFQSSMTKILEPFRKQNPDIVIYQYMDDLYVGSDLEIGQHRTKIEELRQHLLRWGLTTPDKKHQKEPPFLWMGYELHPDKWTVQPIVLPEKDSWTVNDIQKLVGKLNWASQIYPGIKVRQLCKLLRGTKALTEVIPLTEEAELELAENREILKEPVHGVYYDPSKDLIAEIQKQGQGQWTYQIYQEPFKNLKTGKYARMRGAHTNDVKQLTEAVQKITTESIVIWGKTPKFKLPIQKETWETWWTEYWQATWIPEWEFVNTPPLVKLWYQLEKEPIVGAETFYVDGAANRETKLGKAGYVTNRGRQKVVTLTDTTNQKTELQAIYLALQDSGLEVNIVTDSQYALGIIQAQPDQSESELVNQIIEQLIKKEKVYLAWVPAHKGIGGNEQVDKLVSAGIRKVL

SEQ ID NO: 16 - protein, 560 aa, Human immunodeficiency virus
PISPIETVPVKLKPGMDGPRVKQWPLTEEKIKALTEICKEMEEEGKISKIGPENPYNTPIFAIKKKDSTKWRKLVDFRELNKRTQDFWEVQLGIPHPAGLKKKKSVTVLDVGDAYFSVPLDEDFRKYTAFTIPSINNETPGVRYQYNVLPQGWKGSPAIFQSSMTRILEPFRANNPEMVIYQYMDDLYVGSDLEIGQHRAKIEELREHLLKWGFTTPDKKHQKEPPFLWMGYELHPDKWTVQPIQLPDKESWTVNDIQKLVGKLNWASQIYPGIKVTHLCKLLRGAKALTDIVSLTAEAEMELAENREILREPVHGVYYDPSKELIAEVQKQGLDQWTYQIYQEPYKNLKTGKYAKRGSAHTNDVKQLTEVVQKIATESIVIWGKTPKFKLPIRKETWEIWWTDYWQATWIPEWEFVNTPPLVKLWYRLETEPIPGAETYYVDGAANRETKLGKAGYVTDKGKQKIITLTETTNQKAELQAIQLALQDSRSEVNIVTDSQYALGIIQAQPDRSEAELVNQIIEQLIKKEKVYLSWVPAHKGIGGNEQVDKLVSSGIRKVL

SEQ ID NO: 17 - protein, 560 aa, Human immunodeficiency virus
PISPIETVPVKLKPGMDGPKIKQWPLTEEKIKALTQICAEMEEEGKISRVGPENPYNTPVFAIKKKDSTKWRKLVDFRELNKRTQDFWEVQLGIPHPAGLKKKKSVTVLDVGDAYFSVPLYEDFRKYTAFTIPSINNETPGIRYQYNVLPQGWKGSPAIFQCSMTKILKPFRERNPEIVIYQYMDDLYVGSDLEIEQHRRKIKELREHLLKWGFTTPDKKHQKEPPFLWMGYELHPDKWTVQPIQLPEKEDWTVNDIQKLVGKLNWASQIYPGIKVKQLCKLLKGAKALTDIVPLTREAELELAENKEILKEPVHGVYYDSAKELIAEVQKQGLDQWTYQIYQEPFKNLKTGKYAKRRSAHTNDVKQLAEVVQKIALEAIVIWGKTPKFRLPIQRETWETWWTDYWQATWIPEWEFVNTPPLVKLWYQLEKEPIMGAETFYVDGASNRETKTGKAGYVTDKGRQKVVTLTDTTNQKTELHAIYLALRDSGLEVNIVTDSQYALGIIQAQPDKSESELVNQIIEELIKKEKVYLSWVPAHKGIGGNEQVDKLVSSGIRKVL

SEQ ID NO: 18 - protein, 560 aa, Human immunodeficiency virus
PISPIETVPVKLKPGMDGPKIKQWPLTEEKIKALTQICAELEEEGKISRIGPENPYNTPVFAIKKKDSTKWRKLVDFRELNKRTQDFWEVQLGIPHPAGLKKKKSVTVLDVGDAYFSVPLYEDFRKYTAFTIPSINNETPGIRYQYNVLPQGWKGSPAIFQCSMTKILKPFRERNPEIVIYQYMDDLYVGSDLEIEQHRRKIKELREHLLKWGFYTPDKKHQKEPPFLWMGYELHPDKWTVQPIQLPEKEDWTVNDIQKLVGKLNWASQIYPGIKIKELCKLIRGAKALTDIVPLTREAELELAENKEILKEPVHGVYYDPARELIAEVQKQGLDQWTYQIYQEPFKNLKTGKYAKRRSAHTNDVKQLSQVVQKIALEAIVIWGKTPKFRLPIQKETWETWWTDYWQATWIPEWEFVNTPPLVKLWYQLEKEPIMGAETFYVDGASNRETKVGKAGYVTDKGRQKVITLTDTTNQKTELQAIYLALQDSGIEVNIVTDSQYALGIIQAQPDKSESELVNQIIEELIKKEKVYLSWVPAHKGIGGNEQVDKLVSSGIRKVL

SEQ ID NO: 19 - protein, 560 aa, Human immunodeficiency virus
PISPIETVPVKLKPGMDGPKVKQWPLTEEKIKALTEICTEMEKEGKISKIGPENPYNTPVFAIKKKDSTKWRKLVDFRELNKRTQDFWEVQLGIPHPAGLKKKRSVTVLDVGDAYFSVPLDKEFRKYTAFTIPSINNETPGIRYQYNVLPQGWKGSPAIFQSSMIKILEPFRKENPEIVIYQYMDDLYVGSDLEIGQHRAKIEELREHLLRWGFTTPDKKHQKEPPFLWMGYELHPDKWTVQAIQLPDKSSWTVNDIQKLVGKLNWASQIYPGIRVKHLCKLLRGTKALTDVVPLTAEAELELAENREILKEPVHGVYYDPSKDLIAEIQKQGHDQWTYQIYQEPHKNLKTGKYARRKSAHTNDVKQLTEVVQKVATEGIVIWGKVPKFRLPIQKETWEIWWTEYWQATWIPEWEFVNTPPLVKLWYQLETEPIIGAETFYVDGAANRETKLGKAGYITDRGRQKVVSLTETTNQKTELQAIQLALQDSGSEVNIVTDSQYALGIIQAHPDKSESEIVNQIIEQLIQKERVYLSWVPAHKGIGGNEQVDKLVSTGIRKVL

SEQ ID NO: 20 - protein, 560 aa, Human immunodeficiency virus
PISPIETVPVKLKPGMDGPRVKQWPLTEEKIKALTEICTEMEKEGKISKIGPENPYNTPVFAIKKKDSTKWRKLVDFRELNKRTQDFWEVQLGIPHPAGLKKKKSVTVLDVGDAYFSVPLDKEFRKYTAFTIPSINNETPGIRYQYNVLPQGWKGSPAIFQCSMTKILEPFRAKNPEIVIYQYMDDLYVGSDLEIGQHRTKIEELREHLLKWGFTTPDKKHQKEPPFLWMGYELHPDKWTVQPIQLPEKSSWTVNDIQKLVGKLNWASQIYPGIRIKHLCRLLRGAKALTDVVPLTAEAELELAENREIIKEPVHGVYYDPSKDLIAEIQKQGHDQWTYQIYQEPYKNLKTGKYAKRKSAHTNDVKQLTEVVQKIATESIVIWGKIPKFRLPIQKETWEIWWTEYWQATWIPEWEFVNTPPLVKLWYQLETEPIAGAETFYVDGAANRETKLGKAGYVTDRGRQKVVPLTETTNQKTELQAIHLALQDSGSEVNIVTDSQYALGIIQAQPDKSESELVNQIIEQLIQKEKVYLSWVPAHKGIGGNEQVDKLVSSGIRKVL

SEQ ID NO: 21 - protein, 560 aa, Human immunodeficiency virus
PISPIETVPVKLKPGMDGPRVKQWPLTEEKIKALTEICKDMEKEGKILKIGPENPYNTPVFAIKKKDSTKWRKLVNFRELNKRTQDFWEVQLGIPHPAGLKKKKSVTVLDVGDAYFSVPLDEDFRKYTAFTIPSINNETPGIRYQYNVLPQGWKGSPAIFQSSMTKILEPFRTKNPEIVIYQYMDDLYVGSDLEIGQHRTKIEELREHLLKWGFTTPDKKHQKEPPFLWMGYELHPDKWTVQPIQLPDKESWTVNDIQKLVGKLNWASQIYPGIKVKQLCKLLRGAKALTDIVPLTAEAELELAENREILKEPVHGVYYDPSKDLIAEIQKQGQGQWTYQIYQEQYKNLKTGKYARIKSAHTNDVKQLTEAVQKIAQESIVIWGKTPKFRLPIQKETWEAWWTEYWQATWIPEWEFVNTPPLVKLWYQLETEPIVGAETFYVDGAANRETKKGKAGYVTDRGRQKVVSLTETTNQKTELQAIHLALQDSGSEVNIVTDSQYALGIIQAQPDKSESEIVNQIIEQLIQKDKVYLSWVPAHKGIGGNEQVDKLVSSGIRKVL

SEQ ID NO: 22 - protein, 560 aa, Human immunodeficiency virus
PISPIETVPVKLKPEMDGPKVKQWPLTEEKIKALTEICNEMEKEGKISKIGPENPYNTPVFAIKKKDSTKWRKLVDFRELNKRTQDFWEVQLGIPHTAGLKKKKSVTVLDVGDAYFSVPLDESFRKYTAFTIPSINNETPGVRYQYNVLPQGWKGSPSIFQSSMTKILEPFRSQHPDIVIYQYMDDLYVGSDLEIGQHRAKIEELRAHLLSWGFITPDKKHQKEPPFLWMGYELHPDKWTVQPIQLPEKDSWTVNDIQKLVGKLNWASQIYAGIKVKQLCKLLRGAKALTDIVTLTEEAELELAENREILKDPVHGVYYDPSKDLVAEIQKQGQDQWTYQIYQEPFKNLKTGKYARKRSAHTNDVKQLTEVVQKVSTESIVIWGKIPKFRLPIQKETWEAWWMEYWQATWIPEWEFVNTPPLVKLWYQLEKDPIAGAETFYVDGAANRETKLGKAGYVTDRGRQKVVSLTETTNQKTELHAIHLALQDSGSEVNIVTDSQYALGIIQAQPDRSESEIVNQIIEKLIEKEKVYLSWVPAHKGIGGNEQVDKLVSSGIRKVL

SEQ ID NO: 23 - protein, 560 aa, Human immunodeficiency virus
PISPIETVPVKLKPGMDGPKVKQWPLTEEKIKALVEICTEMEKEGKISKIGPENPYNTPVFAIKKKDSTKWRKLVDFRELNKRTQDFWEVQLGIPHPAGLKKKKSVTVLDVGDAYFSVPLDKEFRKYTAFTIPSINNETPRIRYQYNVLPQGWKGSPAIFQSSMTKILEPFKKQNPEIVIYQYMDDLYVGSDLEIGQHRIKIEELREHLLKWGFTTPDKKHQKEPPFLWMGYELHPDKWTVQPIVLPEKDSWTVNDIQKLVGKLNWASQIYAGIKVKQLCKLLRGTKALTEVVQLTKEAELELAENREILKEPVHGVYYDPSKDLIAEIQKQGQGQWTYQIYQEPFKNLKTGKYARMRGAHTNDVKQLTEAVQKVATESIVIWGKTPKFKLPIQKETWEAWWTEYWQATWIPEWEFVNTPPLVKLWYQLEKEPIIGAETFYVDGAANRETKLGKAGYVTDRGRQKVVSLTDTTNQKTELQAIHLALQDSGLEVNIVTDSQYALGIIQAQPDKSESELVSQIIEQLIKKEKVYLAWVPAHKGIGGNEQVDRLVSTGIRKVL

SEQ ID NO: 24 - protein, 560 aa, Human immunodeficiency virus
PISPIETVPVKLKPGMDGPKVKQWPLTEEKIKVLIEICTEMEKEGKISKVGPENPYNTPVFAIKKKDSTKWRKLVDFRELNKRTQDFWEVQLGIPHPAGLKKKKSVTVLDVGDAYFSVPLDKDFRKYTAFTIPSINNETPGIRYQYNVLPQGWKGSPAIFQSSMTKILEPFRKQNPDIVIYQYMDDLYVGSDLEIGQHRTKIEELRQHLLRWGFTTPDKKHQKEPPFLWMGYELHPDKWTVQPIMLPEKDSWTVNDIQKLVGKLNWASQIYAGIKVKNLCKLLRGTKALTEVIPLTEEAELELAENREILKEPVHGVYYDPSKDLVAELQKQGQGQWTYQIYQEPFKNLKTGKYARMRGAHTNDVKQLTEAVQKITQESIVIWGKTPKFKLPIQKETWEAWWTEYWQATWIPEWEFVNTPPLVKLWYQLEKDPIVGAETFYVDGAANRETKLGKAGYVTDRGRQKVVSLTDTTNQKTELQAIHLALQDSGLEVNIVTDSQYALGIIQAQPDKSESELVSQIIEQLIKKEKVYLAWVPAHKGIGGNEQVDKLVSAGIRKVL

SEQ ID NO: 25 - protein, 560 aa, Human immunodeficiency virus
PISPIETVPVKLKPGMDGPKVKQWPLTEEKIKALVEICTEMEKEGKISKIGPENPYNTPVFAIKKKDSTKWRKLVDFRELNKRTQDFWEVQLGIPHPAGLKKKKSVTVLDVGDAYFSVPLDEDFRKYTAFTIPSINNETPGIRYQYNVLPQGWKGSPAIFQSSMTKILEPFRKQNPDIVIYQYMDDLYVGSDLEIGQHRTKIEELRQHLLRWGLTTPDKKHQKEPPFLWMGYELHPDKWTVQPIVLPEKDSWTVNDIQKLVGKLNWASQIYPGIKVRQLCKLLRGTKALTEVIPLTEEAELELAENREILKEPVHGVYYDPSKDLIAEIQKQGQGQWTYQIYQEPFKNLKTGKYARMRGTHTNDVKQLTEAVQKITTESIVIWGKTPKFKLPIQKETWETWWTEYWQATWIPEWEFVNTPPLVKLWYQLEKEPIVGAETFYVDGAANRETKLGKAGYVTNKGRQKVVPLTNTTNQKTELQAIYLALQDSGLEVNIVTDSQYALGIIQAQPDKSESELVNQIIEQLIKKEKVYLAWVPAHKGIGGNEQVDKLVSAGIRKIL

SEQ ID NO: 26 - protein, 560 aa, Human immunodeficiency virus
PISPIETVPVKLKPGMDGPKVKQWPLTEEKIKALVEICTEMEKEGKISKIGPENPYNTPVFAIKKKDSTKWRKLVDFRELNKRTQDFWEVQLGIPHPAGLKKKKSVTVLDVGDAYFSVPLHEDFRKYTAFTIPSINNETPGTRYQYNVLPQGWKGSPAIFQSSMTTILEPFRKQNPDLVIYQYMDDLYVGSDLEIGQHRTKIEELRQHLLRWGFTTPDKKHQKEPPFLWMGYELHPDKWTVQPIVLPEKDSWTVNDIQKLVGKLNWASQIYAGIKVRQLCKLLRGTKALTEVIPLTEEAELELAENREILKEPVHGVYYDPSKDLIAEIQKQGQGQWTYQIYQEPFKNLKTGKYARTRGAHTNDVKQLTEAVQKIATESIVIWGKTPKFKLPIQKETWETWWTEYWQATWIPEWEFVNTPPLVKLWYQLEKEPIIGAETFYVDGAANRETKLGKAGYVTNKGRQKVVSLTDTTNQKTELQAIYLALQDSGLEVNIVTDSQYALGIIQAQPDRSESELVSQIIEQLIKKEKVYLAWVPAHKGIGGNEQVDKLVSAGIRKVL

SEQ ID NO: 27 - protein, 560 aa, Homo sapiens
PISPIETVPVKLKPGMDGPKVKQWPLTEEKIKALVEICTEMEKEGKISKIGPENPYNTPVFAIKKKDSTKWRKLVDFRELNRRTQDFWEVQLGIPHPAGLKKKKSVTVLDVGDAYFSVPLDKDFRKYTAFTIPSINNETPGIRYQYNVLPQGWKGSPAIFQSSMTKILEPFRKQNPDIIIYQYMDDLYVGSDLEIGQHRTKIEELRQHLLKWGFTTPDKKHQKEPPFLWMGYELHPDKWTVQPIVLPEKDSWTVNDIQKLVGKLNWASQIYAGIKVKQLCKLLRGTKALTEVIPLTKEAELELAENREILKEPVHGVYYDPSKDLIVEIQKQGQGQWTYQIFQEPFKNLKTGKYARTRGAHTNDVKQLTEAVQKIANESIVIWGKIPKFKLPIQKETWETWWTEYWQATWIPEWEFVNTPPLVKLWYQLEKEPIVGAETFYVDGAANRETKLGKAGYVTSRGRQKVVSLTDTTNQKTELQAIHLALQDSGLEVNIVTDSQYALGIIQAQPDKSESELVSQIIEQLIKKEKVYLAWVPAHKGIGGNEQVDKLVSAGIRKVL

SEQ ID NO: 28 - protein, 560 aa, Human immunodeficiency virus
  misc_feature (407)..(407): Xaa can be any naturally occurring amino acid
PISPIETVPVKLKPGMDGPKVKQWPLTEEKIKALIEICTEMEKEGKISKIGPENPYNTPVFAIKKKDSTKWRKLVDFRELNKKTQDFWEVQLGIPHPAGLKKKKSVTVLDVGDAYFSVPLDKDFRKYTAFTIPSINNETPGIRYQYNVLPQGWKGSPAIFQSSMTKILEPFRKQNPDIVIYQYMDDLYVGSDLEIGQHRAKIEELRRHLLRWGFTTPDKKHQKEPPFLWMGYELHPDKWTVQPIVLPEKDSWTVNDIQKLVGKLNWASQIYAGIKVKQLCKLLRGTKALTEVIPLTEEAELELAENREILKEPVHGVYYDPSKDLIAEVQKQGQGQWTYQIYQEPFKNLKTGKYARMRGAHTNDVKQLTEAVQKIATESIVIWGKTPKFRLPIQKETWETWWTEYTXATWIPEWEVVNTPPLVKLWYQLEKEPIVGAETFYVDGAANRETKKGKAGYVTNRGRQKVVSLTDTTNQKTELQAIHLALQDSGLEVNIVTDSQYALGIIQAQPDKSESELVSQIIEQLIKKEKVYLAWVPAHKGIGGNEQVDKLVSAGIRKVL

SEQ ID NO: 29 - protein, 560 aa, Human immunodeficiency virus
PISPIETVPVKLKPGMDGPKVKQWPLTEEKIKALTEICTEMEKEGKISRVGPENPYNTPIFAIKKKDSTKWRKLVDFRELNKRTQDFWEVQLGIPHPAGLKKKKSVTVLDVGDAYFSVPLDKDFRKYTAFTIPSINNETPGIRYQYNVLPQGWKGSPAIFQSSMTKILEPFRKQNPEIVIYQYMDDLYVGSDLEIGQHRTKIEELREHLLRWGFTTPDKKHQKEPPFLWMGYELHPDKWTVQSIKLPEKESWTVNDIQKLVGKLNWASQIYPGIKVRQLCKLLRGTKALTEVIPLTEEAELELAENREILKEPVHGVYYDPSKDLIAEIQKQGHGQWTYQIYQEPFKNLKTGKYARMRGAHTNDVKQLAEVVQKISTESIVIWGKTPKFRLPIQKETWETWWVEYWQATWIPEWEFVNTPPLVKLWYQLEKEPIIGAETFYVDGAANRETKLGKAGYVTDRGRQKVVPFTDTTNQKTELQAINLALQDSGLEVNIVTDSQYALGIIQAQPDKSESELVSQIIEQLIKKEKVYLAWVPAHKGIGGNEQVDKLVSQGIRKVL

SEQ ID NO: 30 - protein, 560 aa, Human immunodeficiency virus
PISPIETVPVKLKPGMDGPKVKQWPLTEEKIKALTEICTEMEKEGKISRIGPENPYNTPIFAIKKKDSTKWRKLVDFRELNKRTQDFWEVQLGIPHPAGLKKKKSVTVLDVGDAYFSVPLDEDFRKYTAFTIPSINNETPGIRYQYNVLPQGWKGSPAIFQSSMTKILEPFRKQNPEIVIYQYMDDLYVGSDLEIGQHRTKIEELREHLLRWGFTTPDKKHQKEPPFLWMGYELHPDKWTVQPINLPEKESWTVNDIQKLVGKLNWASQIYAGIKVKQLCKLLRGTKALTEVVPLTEEAELELAENREILKEPVHGVYYDPSKDLIAELQKQGDGQWTYQIYQEPFKNLKTGKYARTRGAHTNDVKQLTEAVQKIATESIVIWGKTPKFKLPIQKETWETWWIEYWQATWIPEWEFVNTPPLVKLWYQLEKEPIIGAETFYVDGAANRETKLGKAGYVTDRGRQKVVPFTDTTNQKTELQAINLALQDSGLEVNIVTDSQYALGIIQAQPDKSESELVSQIIEQLIKKEKVYLAWVPAHKGIGGNEQVDKLVSQGIRKVL

SEQ ID NO: 31 - protein, 560 aa, Human immunodeficiency virus
  misc_feature (281)..(281): Xaa can be any naturally occurring amino acid
PISPIETVPVTLKPGMDGPKVKQWPLTEEKIKALTEICLEMEKEGKISKIGPENPYNTPIFAIKKKNSTRWRKLVDFRELNKRTQDFWEVQLGIPHPAGLKKKKSVSVLDVGGAYFSVPLHEDFRKYTAFTIPSTNNETPGIRYQYNVLPQGWKGSPAIFQSSMTKILEPFRKQNPEVIIYQYMDDLYVGSDLEIGQHREKIEELRAHLLRWGFTTPDQKHQKEPPFLWMGYELHPDKWTVQPVKLPEKDSWTVNDIQKLVGKLNWASQIYPGIKVKQLCXLLRGAKALTEIVPLTKEAELELAENREILKEPVHGAYYDPSKELIAEIQKQGPDQWTYQIYQEPFKNLKTGKYAKMRSAHTNDVKQLTEVVQKIATESIVIWGKIPKFRLPIQKETWETWWTEHWQATWIPEWEFVNTPHLVKLWYQLETEPIEGAETYYVDGAANRETKMGKAGYVTDRGKQKIVSLTETTNQKTELQAIYLALQESGPEVNIVTDSQYALGIIQAQPDKSESELVNQIIEELIKKEKFYLSWVPAHKGIGGNEQVDKLVSSGIRKVL

SEQ ID NO: 32 - protein, 560 aa, Human immunodeficiency virus
PISPIETVPVKLKPGMDGPKVKQWPLTEEKIKALTEICTEMEKEGKISRIGPENPYSTPIFAIKKKDSTKWRKLVDFRELNKRTQDFWEVQLGIPHPAGLKKKKSVSVLDVGDAYFSVPLDKEFRKYTAFTIPSINNETPGIRYQYNVLPQGWKGSPAIFQSSMTKILAPFREQNPEMVIYQYMDDLYVGSDLEIGQHRAKIEELRAHLLKWGFTTPDKKHQKEPPFLWMGYELHPDKWTVQTVKLPEKDSWTVNDIQKLVGKLNWASQIYPNIKVKQLCKLLRGAKALTDIIPLTKEAELELAENREILREPIHGVYYDPSKDLIAEIRKQGQGQWTYQIYQEPFKNLKTGKYAKMRTAHTNDIKQLTEAVQKISTESIVIWGKIPKFRLPIQKETWETWWTEYWQATWIPEWEFVNTPHLVKLWYQLETEPIAGAETYYIDGAANRETKLGKAGYVTDRGKQKVVSLTETTNQKTELQAIYLALQDSGLEVNIVTDSQYALGIIQAQPDKSESELVNQIIEELIKKEKVYLSWVPAHKGIGGNEQVDKLVSSGVRKVL

SEQ ID NO: 33 - protein, 560 aa, Human immunodeficiency virus
  misc_feature (109)..(109): Xaa can be any naturally occurring amino acid
  misc_feature (357)..(357): Xaa can be any naturally occurring amino acid
  misc_feature (550)..(550): Xaa can be any naturally occurring amino acid
  misc_feature (558)..(558): Xaa can be any naturally occurring amino acid
PISPIETVPVKLKPGMDGPRVKQWPLTAEKIEALREICTEMEKEGKISRIGPENPYNTPIFAIKKKDSTKWRKLVDFRELNKRTQEFWEVQLGIPHPAGLKQKKSVTVXDVGDAYFSCPLDKDFRKYTAFTIPSINNETPGIRYQYNVLPQGWKGSPAIFQSSMTKILEPFRKKHPEIIIYQYMDDLYVGSDLEIAQHRETVEELRGHLLKWGFTTPDKKHQKEPPFLWMGYELHPDKWTVQPIKLPEKEVWTVNDIQKLVGKLNWASQIYPGIKVKQLCKLIRGTKALTEVVTFTQEAELELAENREILKEPLHGVYYDPGKELIAEIQKQGQGQWTYQIYQEPYKNLKTGKYAKXRSAHTNDIKELAAVVQKVATESIVIWGKTPKFKLPVQKEVWETWWTEHWQATWIPEWEFVNTPPLVKLWYQLETEPISGAETYYVDGAANKETKLGKAGFVTDRGRQKVVSIENTTNQKAELQAILLALQESGQEANIVTDSQYAMGIIHSQPDKSESDLVGQIIEELIKKERVYLSWVPAHKGIGGNEQVDXLVSSGIRXVL

SEQ ID NO: 34 - protein, 560 aa, Human immunodeficiency virus
PISPIETVPVKLKPGMDGPKVKQWPLTTEKIEALREICTEMEKEGKISRIGPENPYNTPIFAIKKKDSTKWRKLVDFRELNKRTQDFWEVQLGIPHPAGLKQKKSVTVLDVGDAYFSCPLDKDFRKYTAFTIPSINNETPGIRYQYNVLPQGWKGSPAIFQSTMTKILEPFREKHPEIIIYQYMDDLYVGSDLELAQHREAVEDLRDHLLKWGFTTPDKKHQKEPPFLWMGYELHPDKWTVQPIKLPEKDVWTVNDIQKLVGKLNWASQIYPGIRVKQLCKLIRGTKALTEVVNFTEEAELELAENREILKEPLHGVYYDPGKELVAEIQKQGQGQWTYQIYQELHKNLKTGKYAKMRSAHTNDIKQLVEVVRKVATESIVIWGKTPKFRLPVQKEVWEAWWTDHWQATWIPEWEFVNTPPLVKLWYQLETEPISGAETFYVDGAANRETKLGKAGFVTDRGRQKVVSIADTTNQKAELQAILMALQESGRDVNIVTDSQYAMGIIHSQPDKSESELVSQIIEELIKKERVYLSWVPAHKGIGGNEQVDKLVSSGIRKIL

SEQ ID NO: 35 - protein, 560 aa, Human immunodeficiency virus
PISPIAPVPVKLKPGMDGPKVKQWPLSREKIEALTAICQEMEQEGKISRIGPENPYNTPIFAIKKKDSTKWRKLVDFRELNKRTQDFWEVQLGIPHPGGLKQRQSVTVLDVGDAYFSCPLDPDFRKYTAFTIPSVNNETPGVRYQYNVLPQGWKGSPAIFQSSMTKILDPFRKSNPEVEIYQYIDDLYVGSDLPLAEHRKRVELLREHLYQWGFTTPDKKHQKEPPFLWMGYELHPDKWTVQPIQLPDKEVWTVNDIQKLVGKLNWASQIYQGIRVKELCKLIRGTKSLTEVVPLSKEAELELEENREKLKEPVHGVYYQPDKDLWVSIQKHGEGQWTYQVYQDEHKNLKTGKYARQKASHTNDIRQLAEVVQKVSQEAIVIWGKLPKFRLPVTRETWETWWAEYWQATWIPEWEFVSTPPLIKLWYQLETEPIVGAETFYVDGAANRNTKLGKAGYVTEQGKQNIIKLEETTNQKAELMAVLIALQDSKEQVNIVTDSQYVLGIISSQPTQSDSPIVQQIIEELTKKERVYLTWVPAHKGIGGNEKIDKLVSKDIRRVL

SEQ ID NO: 36 - protein, 671 aa, Moloney murine sarcoma virus
TLNIEDEHRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFDEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGTAGFCRLWIPGFAEMAAPLYPLTKTGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGLLTSEGKEIKNKDEILALLKALFLPKRLSIIHCPGHQKGHSAEARGNRMADQAARKAAITETPDTSTLL

SEQ ID NO: 37 - protein, 560 aa, Simian immunodeficiency virus
PISPIETIPVKLKPGMDGPRVKQWPLTEEKIKALTEICTEMEKEGKISRIGPENPYNTPIFAIKKKDSTKWRKLVDFRELNKRTQDFWEVQLGIPHPAGLKKKKSVTVLDVGDAYFSCPLDENFRKYTAFTIPSVNNETPGIRYQYNVLPQGWKGSPAIFQSTMTKILEPFRKNNPELVIYQYMDDLYVGSDLEITQHREAVERLRSHLLTWGFTTPDKKHQKEPPFLWMGYELHPDKWTVQTIQLPEKDTWTVNDIQQLVGKLNWASQIYPGIKVKQLCKLIRGAKALTEVVTLTREAELELAENREILKEPVHGAYYNPDKELIAEIQKQGQGQWTYQIYQDLHKNLKTGKYAKMRSTHTNDIRQLTEVVQKVALESIVIWGKTPKFRLPVQKEVWETWWTEYWQATWIPDWEFVNTPPLVKLWYQLETEPISGAETYYVDGAANRETKLGKAGFVTDRGRQKVTSISETTNQQAELQAVLMALQDAGQEVNIVTDSQYVLGIIHSQPDKSESELVNQIIEELIKKERIYLSWVPAHKGIGGNEQIDKLVSTGIRKVL

SEQ ID NO: 38 - protein, 559 aa, Human immunodeficiency virus
PVARIEPVKVQLKPEKDGPKIRQWPLSKEKILALKEICEKMEKEGQLEEAPPTNPYNSPTFAIKKKDKNKWRMLIDFRELNKVTQEFTEVQLGIPHPAGLASKKRITVLDVGDAYFSVPLDPDFRQYTAFTLPAVNNAEPGKRYLYKVLPQGWKGSPAIFQYTMAKVLDPFRKANNDVTIIQYMDDILVASDRSDLEHDRVVSQLKELLNNMGFSTPEEKFQKDPPFKWMGYELWPKKWKLQKIQLPEKEVWTVNDIQKLVGVLNWAAQLFPGIKTRHICKLIRGKMTLTEEVQWTELAEAEFQENKIILEQEQEGSYYKEGVPLEATVQKNLANQWTYKIHQGDKILKVGKYAKVKNTHTNGVRLLAHVVQKIGKEALVIWGEIPMFHLPVERETWDQWWTDYWQVTWIPEWDFVSTPPLIRLAYNLVKDPLEGVETYYTDGSCNKASKEGKAGYVTDRGKDKVKPLEQTTNQQAELEAFALALQDSGPQVNIIVDSQYVMGIVAAQPTETESPIVREIIEEMIKKEKIYVGWVPAHKGLGGNQEVDHLVSQGIRQIL

SEQ ID NO: 39 - protein, 556 aa, Feline immunodeficiency virus
AQISDKIPIVKVKMKDPNKGPQIKQWPLSNEKIEALTEIVERLEREGKVKRADPNNPWNTPVFAIKKKSGKWRMLIDFRELNKLTEKGAEVQLGLPHPAGLQMKKQITVLDIGDAYFTNPLDPDYAPYTAFTLPRKNNAGPGRRFVWCSLPQGWILSPLIYQSTLDNIIQPFIRQNPQLDIYQYMDDIYIGSNLSKKEHKEKVEELRKLLLWWGFETPEDKLQEEPPYKWMGYELHPLTWTIQQKQLEIPEKPTLNELQKLAGKINWASQTIPELSIKSLTNMTRGNQNLNSTREWTEEARLEVQKAKRAIEEQVQLGYYDPSKELYAKLSLVGPHQISYQVYQKCPEKILWYGKMSRQKKKAENTCDIALRACYKIREESIIRIGKEPRYEIPTSREAWESNLINSPYLKAPPPEVDYIHAALNIKRALSMIKDPPISGAETWYIDGGRKLGKAAKAAYWTDTGKWQVMELEGSNQKAEIQALLLALKAGPEEMNIITDSQYMINILSQQPDKMEGIWQEVLEELEKKTAIFIDWVPGHKGIPGNEEVDKLCQTM

SEQ ID NO: 40 - protein, 718 aa, Equine infectious anemia virus
IELKEGTMGPKIPQWPLTKEKLEGAKETVQRLLSEGKISEASDNNPYNSPIFVIKKRSGKWRLLQDLRELNKTVQVGTEISRGLPHPGGLIKCKHMTVLDIGDAYFTIPLDPEFRPYTAFTIPSINHQEPDKRYVWKCLPQGFVLSPYIYQKTLQEILQPFRERYPEVQLYQYMDDLFVGSNGSKKQHKELIIELRAILQKGFETPDDKLQEVPPYSWLGYQLCPENWKVQKMQLDMVKNPTLNDVQKLMGNITWMSSGVPGLTVKHIAATTKGCLELNQKVIWTEEAQKELEENNEKIKNAQGLQYYNPEEEMLCEVEITKNYEATYVIKQSQGILWAGKKIMKANKGWSTVKNLMLLLQHVATESITRVGKCPTFKVPFTKEQVMWEMQKGWYYSWLPEIVYTHQVVHDDWRMKLVEEPTSGITIYTDGGKQNGEGIAAYVTSNGRTKQKRLGPVTHQVAERMAIQMALEDTRDKQVNIVTDSYYCWKNITEGLGLEGPQNPWWPIIQNIREKEIVYFAWVPGHKGIYGNQLADEAAKIKEEIMLAYQGTQIKEKRDEDAGFDLCVPYDIMIPVSDTKIIPTDVKIQVPPNSFGWVTGKSSMAKQGLLINGGIIDEGYTGEIQVICTNIGKSNIKLIEGQKFAQLIILQHHSNSRQPWDENKISQRGDKGFGSTGVFWVENIQEAQDEHENWHTSPKILARNYKIPLTVAKQITQE

SEQ ID NO: 41 - protein, 713 aa, Caprine arthritis encephalitis virus
PITKVKLKEGCTGPHVPQWPLTEEKLKGLTEIIDKLVEEGKLGKAPPHWTCNTPIFCIKKKSGKWRMLIDFRELNKQTEDLTEAQLGLPHPGGLQKKKHVTILDIGDAYFTIPLYEPYREYTCFTLLSPNNLGPCKRYYWKVLPQGWKLSPSVYQFTMQEILEDWIQQHPEIQFGIYMDDIYIGSDLEIKKHREIVKDLANYIAQYGFTLPEEKRQKGYPAKWLGFELHPQTWKFQKHTLPELTKGTITLNKLQKLVGELVWRQSIIGKSIPNILKLMEGDRELQSERKIEEVHVKEWEACRKKLEEMEGNYYNKDKDVYGQLAWGDKAIEYIVYQEKGKPLWVNVVHNIKNLSIPQQVIKAAQKLTQEVIIRTGKIPWILLPGKEEDWRLELQLGNITWMPKFWSCYRGHTRWRKRNIIEEVVEGPTYYTDGGKKNKVGSLGFIVSTGEKFRKHEEGTNQQLELRAIEEALKQGPQTMNLVTDSRYAFEFLLRNWDEEVIKNPIQARIMEIAHKKDRIGVHWVPGHKGIPQNEEIDKYISEIFLAKEGEGILPKREEDAGYDLICPEEVTIEPGQVKCIPIELRLNLKKSQWAMIATKSSMAAKGVFTQGGIIDSGYQGQIQVIMYNSNKIAVVIPQGRKFAQLILMDKKHGKLEPWGESRKTERGEKGFGSTGMYWIENIPLAEEDHTKWHQDARSLHLEFEIPRTAAEDI

SEQ ID NO: 42 - protein, 571 aa, Maedi visna virus
ANLEEKKIPSTRVRLKEGCKGPHIAQWPLTQEKLEGLKEIVDRLEKEGKVGRAPPHWTCNTPIFCIKKKSGKWRMLIDFRELNKQTEDLAEAQLGLPHPGGLQRKKHVTILDIGDAYFTIPLYEPYRQYTCFTMLSPNNLGPCVRYYWKVLPQGWKLSPAVYQFTMQKILRGWIEEHPMIQFGIYMDDIYIGSDLGLEEHRGIVNELASYIAQYGFMLPEDKRQEGYPAKWLGFELHPEKWKFQKHTLPEITEGPITLNKLQKLVGDLVWRQSLIGKSIPNILKLMEGDRALQSERYIESIHVREWEACRQKLKEMEGNYYDEEKDIYGQLDWGNKAIEYIVFQEKGKPLWVNVVHSIKNLSQAQQIIKAAQKLTQEVIIRTGKIPWILLPGREEDWILELQMGNINWMPSFWSCYKGSVRWKKRNVIAELVPGPTYYTDGGKKNGRGSLGYIASTGEKFRIHEEGTNQQLELRAIEEACKQGPEKMNIVTDSRYAYEFMLRNWDEEVIRNPIQARIMELVHNKEKIGVHWVPGHKGIPQNEEIDRYISEIFLAKEGRGILQKRAEDAGYD

SEQ ID NO: 43 - protein, 631 aa, Bovine immunodeficiency virus
RSLLRSIVTCFTLLVHTEKIEPLPVKVRGPGPKVPQWPLTKEKYQALKEIVKDLLAEGKISEAAWDNPYNTPVFVIKKKGTGRWRMLMDFRELNKITVKGQEFSTGLPYPPGIKECEHLTAIDIKDAYFTIPLHEDFRPFTAFSVVPVNREGPIERFQWNVLPQGWVCSPAIYQTTTQKIIENIKKSHPDVMLYQYMDDLLIGSNRDDHKQIVQEIRDKLGSYGFKTPDEKVQEERVKWIGFELTPKKWRFQPRQLKIKNPLTVNELQQLVGNCVWVQPEVKIPLYPLTDLLRDKTNLQEKIQLTPEAIKCVEEFNLKLKDPEWKDRIREGAELVIKIQMVPRGIVFDLLQDGNPIWGGVKGLNYDHSNKIKKILRTMNELNRTVVIMTGREASFLLPGSSEDWEAALQKEESLTQIFPVKFYRHSCRWTSICGPVRENLTTYYTDGGKKGKTAAAVYWCEGRTKSKVFPGTNQQAELKAICMALLDGPPKMNIITDSRYAYEGMREEPETWAREGIWLEIAKILPFKQYVGVGWVPAHKGIGGNTEADEGVKKALEQMAPCSPPEAILLKPGEKQNLETGIYMQGLRPQSFLPRADLPVAITGTMVDSELQLQLLNIGTEHIRIQKDEVF

SEQ ID NO: 44 - protein, 572 aa, Avian leukosis virus
TVALHLAIPLKWKPDHTPVWIDQWPLPEGKLVALTQLVEKELQLGHIEPSLSCWNTPVFVIRKASGSYRLLHDLRAVNAKLVPFGAVQQGAPVLSALPRGWPLMVLDLKDCFFSIPLAEQDREAFAFTLPSVNNQAPARRFQWKVLPQGMTCSPTICQLVVGQVLEPLRLKHPSLRMLHYMDDLLLAASSHDGLEAAGEEVISTLERAGFTISPDKIQREPGVQYLGYKLGSTYVAPVGLVAEPRIATLWDVQKLVGSLQWLRPALGIPPRLMGPFYEQLRGSDPNEAREWNLDMKMAWREIVQLSTTAALERWDPALPLEGAVARCEQGAIGVLGQGLSTHPRPCLWLFSTQPTKAFTAWLEVLTLLITKLRASAVRTFGKEVDILLLPACFREDLPLPEGILLALKGFAGKIRSSDTPSIFDIARPLHVSLKVRVTDHPVPGPTVFTDASSSTHKGVVVWREGPRWEIKEIADSGASVQQLEARAVAMALLLWPTTPTNVVTDSAFVAKMLLKMGQEGVPSTAAAFILEDALSQRSAMAAVLHVRSHSEVPGFFTEGNDVADSQATFQAY

SEQ ID NO: 45 - protein, 751 aa, Human spumaretrovirus
MNPLQLLQPLPAEIKGTKLLAHWDSGATITCIPESFLEDEQPIKKTLIKTIHGEKQQNVYYVTFKVKGRKVEAEVIASPYEYILLSPTDVPWLTQQPLQLTILVPLQEYQEKILSKTALPEDQKQQLKTLFVKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPESYWLTAFTWQGKQYCWTRLPQGFLNSPALFTADVVDLLKEIPNVQVYVDDIYLSHDDPKEHVQQLEKVFQILLQAGYVVSLKKSEIGQKTVEFLGFNITKEGRGLTDTFKTKLLNITPPKDLKQLQSILGLLNFARNFIPNFAELVQPLYNLIASAKGKYIEWSEENTKQLNMVIEALNTASNLEERLPEQRLVIKVNTSPSAGYVRYYNETGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSQSPVKHPSQYEGVFYTDGSAIKSPDPTKSNNAGMGIVHATYKPEYQVLNQWSIPLGNHTAQMAEIAAVEFACKKALKIPGPVLVITDSFYVAESANKELPYWKSNGFVNNKKKPLKHISKWKSIAECLSMKPDITIQHEKGISLQIPVFILKGNALADKLATQGSYVVN

SEQ ID NO: 46 - DNA, 5824 bp, Artificial sequence
  SEQ ID NO: 46
ggatcccctgagggggcccccatgggctagaggatccggcctcggcctctgcataaataaaaaaaattagtcagccatgagcttggcccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctcccctcgaagcttacatgtggtaccgagctcggatcctgagaacttcagggtgagtctatgggacccttgatgttttctttccccttcttttctatggttaagttcatgtcataggaaggggagaagtaacagggtacacatattgaccaaatcagggtaattttgcatttgtaattttaaaaaatgctttcttcttttaatatacttttttgtttatcttatttctaatactttccctaatctctttctttcagggcaataatgatacaatgtatcatgcctctttgcaccattctaaagaataacagtgataatttctgggttaaggcaatagcaatatttctgcatataaatatttctgcatataaattgtaactgatgtaagaggtttcatattgctaatagcagctacaatccagctaccattctgcttttattttatggttgggataaggctggattattctgagtccaagctaggcccttttgctaatcatgttcatacctcttatcttcctcccacagctcctgggcaacgtgctggtctgtgtgctggcccatcactttggcaaagcacgtgagatctgaattcaacagagatcgatctgtttccttgacactatgaagtgccttttgtacttagcctttttattcattggggtgaattgcaagttcaccatagtttttccacacaaccaaaaaggaaactggaaaaatgttccttctaattaccattattgcccgtcaagctcagatttaaattggcataatgacttaataggcacagccatacaagtcaaaatgcccaagagtcacaaggctattcaagcagacggttggatgtgtcatgcttccaaatgggtcactacttgtgatttccgctggtatggaccgaagtatataacacagtccatccgatccttcactccatctgtagaacaatgcaaggaaagcattgaacaaacgaaacaaggaacttggctgaatccaggcttccctcctcaaagttgtggatatgcaactgtgacggatgccgaagcagtgattgtccaggtgactcctcaccatgtgctggttgatgaatacacaggagaatgggttgattcacagttcatcaacggaaaatgcagcaattacatatgccccactgtccataactctacaacctggcattctgactataaggtcaaagggctatgtgattctaacctcatttccatggacatcaccttcttctcagaggacggagagctatcatccctgggaaaggagggcacagggttcagaagtaactactttgcttatgaaactggaggcaaggcctgcaaaatgcaatactgcaagcattggggagtcagactcccatcaggtgtctggttcgagatggctgataaggatctctttgctgcagccagattccctgaatgcccagaagggtcaagtatctctgctccatctcagacctcagtggatgtaagtctaattcaggacgttgagaggatcttggattattccctctgccaagaaacctggagcaaaatcagagcgggtcttccaatctctccagtggatctcagctatcttgctcctaaaaacccaggaaccggtcctgctttcaccataatcaatggtaccctaaaatactttgagaccagatacatcagagtcgatattgctgctccaatcctctcaagaatggtcggaatgatcagtggaactaccacagaaagggaactgtgggatgactgggcaccatatgaagacgtggaaattggacccaatggagttctgaggaccagttcaggatataagtttcctttatacatgattggacatggtatgttggactccgatcttcatcttagctcaaaggctcaggtgttcgaacatcctcacattcaagacgctgcttcgcaacttcctgatgatgagagtttattttttggtgatactgggctatccaaaaatccaatcgagcttgtagaaggttggttcagtagttggaaaagctctattgcctcttttttctttatcatagggttaatcattggactattcttggttctccgagttggtatccatctttgcattaaattaaagcacaccaagaaaagacagatttatacagacatagagatgaaccgacttggaaagtaactcaaatcctgcacaacagattcttcatgtttggaccaaatcaacttgtgataccatgctcaaagaggcctcaattatatttgagtttttaatttttatggaattcaccccaccagtgcaggctgcctatcagaaagtggtggctggtgtggctaatgccctggcccacaagtttcactaagctcgcttccttgctgtccaatttctattaaaggttccttggttccctaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaatgaagagctagttcaaaccttgggaaaatacactatatcttaaactccatgaaagaaggtgaggctgcaaacagctaatgcacattggcaacagccctgatgcctatgccttattcatccctcagaaaaggattcaagtagaggcttgatttggaggttaaagtttggctatgctgtattttacattacttattgttttagctgtcctcatgaatgtcttttcactacccatttgcttatcctgcatctctcagccttgactccactcagttctcttgcttagagataccacctttcccctgaagtgttccttccatgttttacggcgagatggtttctcctcgcctggccactcagccttagttgtctctgttgtcttatagaggtctacttgaagaaggaaaaacagggggcatggtttgactgtcctgtgagcccttcttccctgcctcccccactcacagtgacccggaatccctcgacatggcagtctagcactagtgcggccgcagatctgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgt

SEQ ID NO: 47 - DNA, 10389 bp, Artificial sequence
  SEQ ID NO: 47
ccagatcctctacgccggacgcatcgtggccggcatcaccggcgccacaggtgcggttgctggcgcctatatcgccgacatcaccgatggggaagatcgggctcgccacttcgggctcatgagcgcttgtttcggcgtgggtatggtggcaggccccgtggccgggggactgttgggcgccatctccttgcatgcaccattccttgcggcggcggtgctcaacggcctcaacctactactgggctgcttcctaatgcaggagtcgcataagggagagcgtcgaatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcacatgagcgaaaaatacatcgtcacctgggacatgttgcagatccatgcacgtaaactcgcaagccgactgatgccttctgaacaatggaaaggcattattgccgtaagccgtggcggtctgtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaatcttttcaacgcctggcactgccgggcgttgttctttttaacttcaggcgggttacaatagtttccagtaagtattctggaggctgcatccatgacacaggcaaacctgagcgaaaccctgttcaaaccccgctttaaacatcctgaaacctcgacgctagtccgccgctttaatcacggcgcacaaccgcctgtgcagtcggcccttgatggtaaaaccatccctcactggtatcgcatgattaaccgtctgatgtggatctggcgcggcattgacccacgcgaaatcctcgacgtccaggcacgtattgtgatgagcgatgccgaacgtaccgacgatgatttatacgatacggtgattggctaccgtggcggcaactggatttatgagtgggccccggatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccaaaaaagaagagaaaggtagaagaccccaaggactttccttcagaattgctaagttttttgagtcatgctgtgtttagtaatagaactcttgcttgctttgctatttacaccacaaaggaaaaagctgcactgctatacaagaaaattatggaaaaatattctgtaacctttataagtaggcataacagttataatcataacatactgttttttcttactccacacaggcatagagtgtctgctattaataactatgctcaaaaattgtgtacctttagctttttaatttgtaaaggggttaataaggaatatttgatgtatagtgccttgactagagatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatcaactggataactcaagctaaccaaaatcatcccaaacttcccaccccataccctattaccactgccaattacctagtggtttcatttactctaaacctgtgattcctctgaattattttcattttaaagaaattgtatttgttaaatatgtactacaaacttagtagttggaagggctaattcactcccaaagaagacaagatatccttgatctgtggatctaccacacacaaggctacttccctgattagcagaactacacaccagggccaggggtcagatatccactgacctttggatggtgctacaagctagtaccagttgagccagataaggtagaagaggccaataaaggagagaacaccagcttgttacaccctgtgagcctgcatgggatggatgacccggagagagaagtgttagagtggaggtttgacagccgcctagcatttcatcacgtggcccgagagctgcatccggagtacttcaagaactgctgatatcgagcttgctacaagggactttccgctggggactttccagggaggcgtggcctgggcgggactggggagtggcgagccctcagatcctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgccgaattcacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccactttggctgatacgcggatctacgcgtggatccgcggcccgggatccaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtaaagcggccgcgactctagatcataatcagccataactagtctcgagctcaagcttcgaattcccgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcatcgggaattctgcagtcgacggtacctttaagaccaatgacttacaaggcagctgtagatcttagccactttttaaaagaaaaggggggactggaagggctaattcactcccaacgaagacaaaatcgtcgagagatgctgcatataagcagctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtagtagttcatgtcatcttattattcagtatttataacttgcaaagaaatgaatatcagagagtgagaggccttgacattataatagatttagcaggaattgaactaggagtggagcacacaggcaaagctgcagaagtacttggaagaagccaccagagatactcacgattctgcacatacctggctaatcccagatcctaaggattacattaagtttactaacatttatataatgatttatagtttaaagtataaacttatctaatttactattctgacagatattaattaatcctcaaatatcataagagatgattactattatccccatttaacacaagaggaaactgagagggaaagatgttgaagtaattttcccacaattacagcatccgttagttacgactctatgatcttctgacacaaattccatttactcctcaccctatgactcagtcgaatatatcaaagttatggacattatgctaagtaacaaattacccttttatatagtaaatactgagtagattgagagaagaaattgtttgcaaacctgaatagcttcaagaagaagagaagtgaggataagaataacagttgtcatttaacaagttttaacaagtaacttggttagaaagggattcaaatgcataaagcaagggataaatttttctggcaacaagactatacaatataaccttaaatatgacttcaaataattgttggaacttgataaaactaattaaatattattgaagattatcaatattataaatgtaatttacttttaaaaagggaacatagaaatgtgtatcattagagtagaaaacaatccttattatcacaatttgtcaaaacaagtttgttattaacacaagtagaatactgcattcaattaagttgactgcagattttgtgttttgttaaaattagaaagagataacaacaatttgaattattgaaagtaacatgtaaatagttctacatacgttcttttgacatcttgttcaatcattgatcgaagttctttatcttggaagaatttgttccaaagactctgaaataaggaaaacaatctattatatagtctcacacctttgttttacttttagtgatttcaatttaataatgtaaatggttaaaatttattcttctctgagatcatttcacattgcagatagaaaacctgagactggggtaatttttattaaaatctaatttaatctcagaaacacatctttattctaacatcaatttttccagtttgatattatcatataaagtcagccttcctcatctgcaggttccacaacaaaaatccaaccaactgtggatcaaaaatattgggaaaaaattaaaaatagcaatacaacaataaaaaaatacaaatcagaaaaacagcacagtataacaactttatttagcatttacaatctattaggtattataagtaatctag

SEQ ID NO: 48 - DNA, 12150 bp, Artificial sequence
  SEQ ID NO: 48
ttgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagagtctataggcccacccccttggcttcttatgcgacggatcgatcccgtaataagcttcgaggtccgcggccggccgcgttgacgcgcacggcaagaggcgaggggcggcgactggtgagagatgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaataaagataggggggcaattaaaggaagctctattagatacaggagcagatgatacagtattagaagaaatgaatttgccaggaagatggaaaccaaaaatgatagggggaattggaggttttatcaaagtaagacagtatgatcagatactcatagaaatctgcggacataaagctataggtacagtattagtaggacctacacctgtcaacataattggaagaaatctgttgactcagattggctgcactttaaattttcccattagtcctattgagactgtaccagtaaaattaaagccaggaatggatggcccaaaagttaaacaatggccattgacagaagaaaaaataaaagcattagtagaaatttgtacagaaatggaaaaggaaggaaaaatttcaaaaattgggcctgaaaatccatacaatactccagtatttgccataaagaaaaaagacagtactaaatggagaaaattagtagatttcagagaacttaataagagaactcaagatttctgggaagttcaattaggaataccacatcctgcagggttaaaacagaaaaaatcagtaacagtactggaggtgggcgatgcatatttttcagttcccttagataaagacttcaggaagtatactgcatttaccatacctagtataaacaatgagacaccagggattagatatcagtacaatgtgcttccacagggatggaaaggatcaccagcaatattccagtgtagcatgacaaaaatcttagagccttttagaaaacaaaatccagacatagtcatctatcaatacatggatgatttgtatgtaggatctgacttagaaatagggcagcatagaacaaaaatagaggaactgagacaacatctgttgaggtggggatttaccacaccagacaaaaaacatcagaaagaacctccattcctttggatgggttatgaactccatcctgataaatggacagtacagcctatagtgctgccagaaaaggacagctggactgtcaatgacatacagaaattagtgggaaaattgaattgggcaagtcagatttatgcagggattaaagtaaggcaattatgtaaacttcttaggggaaccaaagcactaacagaagtagtaccactaacagaagaagcagagctagaactggcagaaaacagggagattctaaaagaaccggtacatggagtgtattatgacccatcaaaagacttaatagcagaaatacagaagcaggggcaaggccaatggacatatcaaatttatcaagagccatttaaaaatctgaaaacaggaaagtatgcaagaatgaagggtgcccacactaatgatgtgaaacaattaacagaggcagtacaaaaaatagccacagaaagcatagtaatatggggaaagactcctaaatttaaattacccatacaaaaggaaacatgggaagcatggtggacagagtattggcaagccacctggattcctgagtgggagtttgtcaatacccctcccttagtgaagttatggtaccagttagagaaagaacccataataggagcagaaactttctatgtagatggggcagccaatagggaaactaaattaggaaaagcaggatatgtaactgacagaggaagacaaaaagttgtccccctaacggacacaacaaatcagaagactgagttacaagcaattcatctagctttgcaggattcgggattagaagtaaacatagtgacagactcacaatatgcattgggaatcattcaagcacaaccagataagagtgaatcagagttagtcagtcaaataatagagcagttaataaaaaaggaaaaagtctacctggcatgggtaccagcacacaaaggaattggaggaaatgaacaagtagataaattggtcagtgctggaatcaggaaagtactatttttagatggaatagataaggcccaagaagaacatgagaaatatcacagtaattggagagcaatggctagtgattttaacctaccacctgtagtagcaaaagaaatagtagccagctgtgataaatgtcagctaaaaggggaagccatgcatggacaagtagactgtagcccaggaatatggcagctagattgtacacatttagaaggaaaagttatcttggtagcagttcatgtagccagtggatatatagaagcagaagtaattccagcagagacagggcaagaaacagcatacttcctcttaaaattagcaggaagatggccagtaaaaacagtacatacagacaatggcagcaatttcaccagtactacagttaaggccgcctgttggtgggcggggatcaagcaggaatttggcattccctacaatccccaaagtcaaggagtaatagaatctatgaataaagaattaaagaaaattataggacaggtaagagatcaggctgaacatcttaagacagcagtacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggaaaggaccagcaaagctcctctggaaaggtgaaggggcagtagtaatacaagataatagtgacataaaagtagtgccaagaagaaaagcaaagatcatcagggattatggaaaacagatggcaggtgatgattgtgtggcaagtagacaggatgaggattaacacatggaattctgcaacaactgctgtttatccatttcagaattgggtgtcgacatagcagaataggcgttactcgacagaggagagcaagaaatggagccagtagatcctagactagagccctggaagcatccaggaagtcagcctaaaactgcttgtaccaattgctattgtaaaaagtgttgctttcattgccaagtttgtttcatgacaaaagccttaggcatctcctatggcaggaagaagcggagacagcgacgaagagctcatcagaacagtcagactcatcaagcttctctatcaaagcagtaagtagtacatgtaatgcaacctataatagtagcaatagtagcattagtagtagcaataataatagcaatagttgtgtggtccatagtaatcatagaatataggaaaatggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatccttggcacttatctgggacgatctgcggagcctgtgcctcttcagctaccaccgcttgagagacttactcttgattgtaacgaggattgtggaacttctgggacgcagggggtgggaagccctcaaatattggtggaatctcctacaatattggagtcaggagctaaagaatagtgctgttagcttgctcaatgccacagccatagcagtagctgaggggacagatagggttatagaagtagtacaaggagcttgtagagctattcgccacatacctagaagaataagacagggcttggaaaggattttgctataagctcgaggccgccccggtgaccttcagaccttggcactggaggtggcccggcagaagcgcggcatcgtggatcagtgctgcaccagcatctgctctctctaccaactggagaactactgcaactaggcccaccactaccctgtccacccctctgcaatgaataaaacctttgaaagagcactacaagttgtgtgtacatgcgtgcatgtgcatatgtggtgcggggggaacatgagtggggctggctggagtggcgatgataagctgtcaaacatgagaattaattcttgaagacgaaagggcctcgtgatacgcctatttttataggttaatgtcatgataataatggtttcttagtctagaattaattccgtgtattctatagtgtcacctaaatcgtatgtgtatgatacataaggttatgtattaattgtagccgcgttctaacgacaatatgtacaagcctaattgtgtagcatctggcttactgaagcagaccctatcatctctctcgtaaactgccgtcagagtcggtttggttggacgaaccttctgagtttctggtaacgccgtcccgcacccggaaatggtcagcgaaccaatcagcagggtcatcgctagccagatcctctacgccggacgcatcgtggccggcatcaccggcgccacaggtgcggttgctggcgcctatatcgccgacatcaccgatggggaagatcgggctcgccacttcgggctcatgagcgcttgtttcggcgtgggtatggtggcaggccccgtggccgggggactgttgggcgccatctccttgcatgcaccattccttgcggcggcggtgctcaacggcctcaacctactactgggctgcttcctaatgcaggagtcgcataagggagagcgtcgaatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcacatgagcgaaaaatacatcgtcacctgggacatgttgcagatccatgcacgtaaactcgcaagccgactgatgccttctgaacaatggaaaggcattattgccgtaagccgtggcggtctgtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaatcttttcaacgcctggcactgccgggcgttgttctttttaacttcaggcgggttacaatagtttccagtaagtattctggaggctgcatccatgacacaggcaaacctgagcgaaaccctgttcaaaccccgctttaaacatcctgaaacctcgacgctagtccgccgctttaatcacggcgcacaaccgcctgtgcagtcggcccttgatggtaaaaccatccctcactggtatcgcatgattaaccgtctgatgtggatctggcgcggcattgacccacgcgaaatcctcgacgtccaggcacgtattgtgatgagcgatgccgaacgtaccgacgatgatttatacgatacggtgattggctaccgtggcggcaactggatttatgagtgggccccggatctttgtgaaggaaccttacttctgtggtgtgacataattggacaaactacctacagagatttaaagctctaaggtaaatataaaatttttaacccggatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccaaaaaagaagagaaaggtagaagaccccaaggactttccttcagaattgctaagttttttgagtcatgctgtgtttagtaatagaactcttgcttgctttgctatttacaccacaaaggaaaaagctgcactgctatacaagaaaattatggaaaaatattctgtaacctttataagtaggcataacagttataatcataacatactgttttttcttactccacacaggcatagagtgtctgctattaataactatgctcaaaaattgtgtacctttagctttttaatttgtaaaggggttaataaggaatatttgatgtatagtgccttgactagagatcataatcagccataccacatttgtagaggttttacttgctttaaaaaacctcccacacctccccctgaacctgaaacataaaatgaatgcaattgttgttgttgggctgcaggaattaattcgagctcgcccgaca

SEQ ID NO: 49 - DNA, 6466 bp, Artificial sequence
  SEQ ID NO: 49
gcggccgctctagagagcttggcccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccggtcgaccgatcctgagaacttcagggtgagtttggggacccttgattgttctttctttttcgctattgtaaaattcatgttatatggagggggcaaagttttcagggtgttgtttagaatgggaagatgtcccttgtatcaccatggaccctcatgataattttgtttctttcactttctactctgttgacaaccattgtctcctcttattttcttttcattttctgtaactttttcgttaaactttagcttgcatttgtaacgaatttttaaattcacttttgtttatttgtcagattgtaagtactttctctaatcacttttttttcaaggcaatcagggtatattatattgtacttcagcacagttttagagaacaattgttataattaaatgataaggtagaatatttctgcatataaattctggctggcgtggaaatattcttattggtagaaacaactacaccctggtcatcatcctgcctttctctttatggttacaatgatatacactgtttgagatgaggataaaatactctgagtccaaaccgggcccctctgctaaccatgttcatgccttcttctctttcctacagctcctgggcaacgtgctggttgttgtgctgtctcatcattttggcaaagaattcctcgacggatctgtcgaggtcgacggtatcgataagcttgatcatgaatataccttgctttgctgtgatcctcagcttagctactacacattctctgggagaattccccttgtatacgattcccgagaaaatagagaaatggacccccatagacatgatccatcttagttgccctaataacatgctgtctgaggaagaaggttgcaatacagagtctcctttcacctacttcgagctcaagagtggttacctagcccatcagaaggtcccaggatttacatgcactggggttgtgaatgaggcagagacatacacaaactttgtcggatatgtcaccaccaccttcaaaaggaagcactttaaacctacagtggctgcttgtcgtgatgcctacaactggaaagtatcaggggacccccgatatgaagaatctctacacaccccgtatcccgacagcagctggttaaggactgtgaccacaaccaaagaagcccttcttataatatcgccaagcattgtagagatggacatatatggcaggacccttcactctcccatgttcccttcggggaaatgttccaagctctatccttctgtcccctcttgtacaaccaaccatgattacacattgtggttgccagaagattctagtctgagtttgatttgcgacatcttcacttccagcagtggacagaaggccatgaatgggtctcgcatctgcggattcaaggatgaaaggggattttacagatccttgaagggatcctgtaagctgacattgtgcgggaaacctggaattaggctgttcgacggaacttgggtctcttttacaaagccggacgttcatgtgtggtgcactcccaaccagttagtcaatatacataacgacagactagatgaggttgaacatctgatcgtggacgatatcatcaagaagagagaggagtgtttagacacgctggaaactatacttatgtctcaatcagttagttttagacggttgagccatttcagaaagttagttccaggatatggaaaagcttacactattttgaacggcagcttaatggaaacaaatgtctactacaaaagagttgacaggtgggcggacattttgccttctaggggatgtctgaaagtcggacaacagtgcatggaccctgtcaaaggggtcctcttcaacggaattatcaagggtccggatggacaaatattgattccagagatgcagtcagagcagctcaaacagcatatggatctgttgaaagcagctatgtttcctctccgtcatcctttaatcaacagagaggcagtcttcaagaaggatggaaatgccgatgattttgttgatctccatatgcctgatgttcaaaaatctgtgtcggatgtcgacctgggcctgcctcattgggggttctggttgttagtcggggcaacagtagtagcctttgtggtcttggcgtgcttgctccgtgtatgttgtaggagaatgagaaggagaaggtcactgcgtgccactcaggatatccccctcagcgttgcccctgcccctgtccctcgtgccaaagtggtgtcatcatgggagtcttctaaagggctcccaggtacttgatgcctttatcatactgcctgacacatagatcacaacctgattacctgcctcggcacagatccactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacggatcggccgcaattcgtaatcatgtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcgggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattggagctccaccgcggtg

SEQ ID NO: 50 - DNA, 10778 bp, Artificial sequence
  SEQ ID NO: 50
ccagatcctctacgccggacgcatcgtggccggcatcaccggcgccacaggtgcggttgctggcgcctatatcgccgacatcaccgatggggaagatcgggctcgccacttcgggctcatgagcgcttgtttcggcgtgggtatggtggcaggccccgtggccgggggactgttgggcgccatctccttgcatgcaccattccttgcggcggcggtgctcaacggcctcaacctactactgggctgcttcctaatgcaggagtcgcataagggagagcgtcgaatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcacatgagcgaaaaatacatcgtcacctgggacatgttgcagatccatgcacgtaaactcgcaagccgactgatgccttctgaacaatggaaaggcattattgccgtaagccgtggcggtctgtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaatcttttcaacgcctggcactgccgggcgttgttctttttaacttcaggcgggttacaatagtttccagtaagtattctggaggctgcatccatgacacaggcaaacctgagcgaaaccctgttcaaaccccgctttaaacatcctgaaacctcgacgctagtccgccgctttaatcacggcgcacaaccgcctgtgcagtcggcccttgatggtaaaaccatccctcactggtatcgcatgattaaccgtctgatgtggatctggcgcggcattgacccacgcgaaatcctcgacgtccaggcacgtattgtgatgagcgatgccgaacgtaccgacgatgatttatacgatacggtgattggctaccgtggcggcaactggatttatgagtgggccccggatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccaaaaaagaagagaaaggtagaagaccccaaggactttccttcagaattgctaagttttttgagtcatgctgtgtttagtaatagaactcttgcttgctttgctatttacaccacaaaggaaaaagctgcactgctatacaagaaaattatggaaaaatattctgtaacctttataagtaggcataacagttataatcataacatactgttttttcttactccacacaggcatagagtgtctgctattaataactatgctcaaaaattgtgtacctttagctttttaatttgtaaaggggttaataaggaatatttgatgtatagtgccttgactagagatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatcaactggataactcaagctaaccaaaatcatcccaaacttcccaccccataccctattaccactgccaattacctagtggtttcatttactctaaacctgtgattcctctgaattattttcattttaaagaaattgtatttgttaaatatgtactacaaacttagtagttggaagggctaattcactcccaacgaagacaagatatccttgatctgtggatctaccacacacaaggctacttccctgattagcagaactacacaccagggccagggatcagatatccactgacctttggatggtgctacaagctagtaccagttgagccagagaagttagaagaagccaacaaaggagagaacaccagcttgttacaacctgtgagcctgcatgggatggatgacccggagagagaagtgttagagtggaggtttgacagccgcctagcatttcatcacggtggcccgagagctgcatccggagtacttcaagaactgctgatatcgagcttgctacaagggactttccgctgggggactttccagggaggcgtggcctgggcgggactggggagtggcgagccctcagatcctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctagcaccgtcgacgaattcacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccactttggctgatatcgagatcagcttggcattccggtactgttggtaaagccaccatggaagacgccaaaaacataaagaaaggcccggcgccattctatccgctggaagatggaaccgctggagagcaactgcataaggctatgaagagatacgccctggttcctggaacaattgcttttacagatgcacatatcgaggtggacatcacttacgctgagtacttcgaaatgtccgttcggttggcagaagctatgaaacgatatgggctgaatacaaatcacagaatcgtcgtatgcagtgaaaactctcttcaattctttatgccggtgttgggcgcgttatttatcggagttgcagttgcgcccgcgaacgacatttataatgaacgtgaattgctcaacagtatgggcatttcgcagcctaccgtggtgttcgtttccaaaaaggggttgcaaaaaattttgaacgtgcaaaaaaagctcccaatcatccaaaaaattattatcatggattctaaaacggattaccagggatttcagtcgatgtacacgttcgtcacatctcatctacctcccggttttaatgaatacgattttgtgccagagtccttcgatagggacaagacaattgcactgatcatgaactcctctggatctactggtctgcctaaaggtgtcgctctgcctcatagaactgcctgcgtgagattctcgcatgccagagatcctatttttggcaatcaaatcattccggatactgcgattttaagtgttgttccattccatcacggttttggaatgtttactacactcggatatttgatatgtggatttcgagtcgtcttaatgtatagatttgaagaagagctgtttctgaggagccttcaggattacaagattcaaagtgcgctgctggtgccaaccctattctccttcttcgccaaaagcactctgattgacaaatacgatttatctaatttacacgaaattgcttctggtggcgctcccctctctaaggaagtcggggaagcggttgccaagaggttccatctgccaggtatcaggcaaggatatgggctcactgagactacatcagctattctgattacacccgagggggatgataaaccgggcgcggtcggtaaagttgttccattttttgaagcgaaggttgtggatctggataccgggaaaacgctgggcgttaatcaaagaggcgaactgtgtgtgagaggtcctatgattatgtccggttatgtaaacaatccggaagcgaccaacgccttgattgacaaggatggatggctacattctggagacatagcttactgggacgaagacgaacacttcttcatcgttgaccgcctgaagtctctgattaagtacaaaggctatcaggtggctcccgctgaattggaatccatcttgctccaacaccccaacatcttcgacgcaggtgtcgcaggtcttcccgacgatgacgccggtgaacttcccgccgccgttgttgttttggagcacggaaagacgatgacggaaaaagagatcgtggattacgtcgccagtcaagtaacaaccgcgaaaaagttgcgcggaggagttgtgtttgtggacgaagtaccgaaaggtcttaccggaaaactcgacgcaagaaaaatcagagagatcctcataaaggccaagaagggcggaaagatcgccgtgtaattctagtagtggccaggatccgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcatcggggtacctttaagaccaatgacttacaaggcagctgtagatcttagccactttttaaaagaaaaggggggactggaagggctaattcactcccaacgaagacaagatcgtcgagagatgctgcatataagcagctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtagtagttcatgtcatcttattattcagtatttataacttgcaaagaaatgaatatcagagagtgagaggccttgacattataatagatttagcaggaattgaactaggagtggagcacacaggcaaagctgcagaagtacttggaagaagccaccagagatactcacgattctgcacatacctggctaatcccagatcctaaggattacattaagtttactaacatttatataatgatttatagtttaaagtataaacttatctaatttactattctgacagatattaattaatcctcaaatatcataagagatgattactattatccccatttaacacaagaggaaactgagagggaaagatgttgaagtaattttcccacaattacagcatccgttagttacgactctatgatcttctgacacaaattccatttactcctcaccctatgactcagtcgaatatatcaaagttatggacattatgctaagtaacaaattacccttttatatagtaaatactgagtagattgagagaagaaattgtttgcaaacctgaatagcttcaagaagaagagaagtgaggataagaataacagttgtcatttaacaagttttaacaagtaacttggttagaaagggattcaaatgcataaagcaagggataaatttttctggcaacaagactatacaatataaccttaaatatgacttcaaataattgttggaacttgataaaactaattaaatattattgaagattatcaatattataaatgtaatttacttttaaaaagggaacatagaaatgtgtatcattagagtagaaaacaatccttattatcacaatttgtcaaaacaagtttgttattaacacaagtagaatactgcattcaattaagttgactgcagattttgtgttttgttaaaattagaaagagataacaacaatttgaattattgaaagtaacatgtaaatagttctacatacgttcttttgacatcttgttcaatcattgatcgaagttctttatcttggaagaatttgttccaaagactctgaaataaggaaaacaatctattatatagtctcacacctttgttttacttttagtgatttcaatttaataatgtaaatggttaaaatttattcttctctgagatcatttcacattgcagatagaaaacctgagactggggtaatttttattaaaatctaatttaatctcagaaacacatctttattctaacatcaatttttccagtttgatattatcatataaagtcagccttcctcatctgcaggttccacaacaaaaatccaaccaactgtggatcaaaaatattgggaaaaaattaaaaatagcaatacaacaataaaaaaatacaaatcagaaaaacagcacagtataacaactttatttagcatttacaatctattaggtattataagtaatctag

SEQ ID NO: 51 - DNA, 12150 bp, Artificial sequence
  SEQ ID NO: 51
ttgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagagtctataggcccacccccttggcttcttatgcgacggatcgatcccgtaataagcttcgaggtccgcggccggccgcgttgacgcgcacggcaagaggcgaggggcggcgactggtgagagatgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaataaagataggggggcaattaaaggaagctctattagatacaggagcagatgatacagtattagaagaaatgaatttgccaggaagatggaaaccaaaaatgatagggggaattggaggttttatcaaagtaagacagtatgatcagatactcatagaaatctgcggacataaagctataggtacagtattagtaggacctacacctgtcaacataattggaagaaatctgttgactcagattggctgcactttaaattttcccattagtcctattgagactgtaccagtaaaattaaagccaggaatggatggcccaaaagttaaacaatggccattgacagaagaaaaaataaaagcattagtagaaatttgtacagaaatggaaaaggaaggaaaaatttcaaaaattgggcctgaaaatccatacaatactccagtatttgccataaagaaaaaagacagtactaaatggagaaaattagtagatttcagagaacttaataagagaactcaagatttctgggaagttcaattaggaataccacatcctgcagggttaaaacagaaaaaatcagtaacagtactggatgtgggcgatgcatatttttcagttcccttagataaagacttcaggaagtatactgcatttaccatacctagtataaacaatgagacaccagggattagatatcagtacaatgtgcttccacagggatggaaaggatcaccagcaatattccagtgtagcatgacaaaaatcttagagccttttagaaaacaaaatccagacatagtcatctatcaatacatggatgatttgtatgtaggatctgacttagaaatagggcagcatagaacaaaaatagaggaactgagacaacatctgttgaggtggggatttaccacaccagacaaaaaacatcagaaagaacctccattcctttggatgggttatgaactccatcctgataaatggacagtacagcctatagtgctgccagaaaaggacagctggactgtcaatgacatacagaaattagtgggaaaattgaattgggcaagtcagatttatgcagggattaaagtaaggcaattatgtaaacttcttaggggaaccaaagcactaacagaagtagtaccactaacagaagaagcagagctagaactggcagaaaacagggagattctaaaagaaccggtacatggagtgtattatgacccatcaaaagacttaatagcagaaatacagaagcaggggcaaggccaatggacatatcaaatttatcaagagccatttaaaaatctgaaaacaggaaagtatgcaagaatgaagggtgcccacactaatgatgtgaaacaattaacagaggcagtacaaaaaatagccacagaaagcatagtaatatggggaaagactcctaaatttaaattacccatacaaaaggaaacatgggaagcatggtggacagagtattggcaagccacctggattcctgagtgggagtttgtcaatacccctcccttagtgaagttatggtaccagttagagaaagaacccataataggagcagaaactttctatgtagatggggcagccaatagggaaactaaattaggaaaagcaggatatgtaactgacagaggaagacaaaaagttgtccccctaacggacacaacaaatcagaagactcagttacaagcaattcatctagctttgcaggattcgggattagaagtaaacatagtgacagactcacaatatgcattgggaatcattcaagcacaaccagataagagtgaatcagagttagtcagtcaaataatagagcagttaataaaaaaggaaaaagtctacctggcatgggtaccagcacacaaaggaattggaggaaatgaacaagtagataaattggtcagtgctggaatcaggaaagtactatttttagatggaatagataaggcccaagaagaacatgagaaatatcacagtaattggagagcaatggctagtgattttaacctaccacctgtagtagcaaaagaaatagtagccagctgtgataaatgtcagctaaaaggggaagccatgcatggacaagtagactgtagcccaggaatatggcagctagattgtacacatttagaaggaaaagttatcttggtagcagttcatgtagccagtggatatatagaagcagaagtaattccagcagagacagggcaagaaacagcatacttcctcttaaaattagcaggaagatggccagtaaaaacagtacatacagacaatggcagcaatttcaccagtactacagttaaggccgcctgttggtgggcggggatcaagcaggaatttggcattccctacaatccccaaagtcaaggagtaatagaatctatgaataaagaattaaagaaaattataggacaggtaagagatcaggctgaacatcttaagacagcagtacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggaaaggaccagcaaagctcctctggaaaggtgaaggggcagtagtaatacaagataatagtgacataaaagtagtgccaagaagaaaagcaaagatcatcagggattatggaaaacagatggcaggtgatgattgtgtggcaagtagacaggatgaggattaacacatggaattctgcaacaactgctgtttatccatttcagaattgggtgtcgacatagcagaataggcgttactcgacagaggagagcaagaaatggagccagtagatcctagactagagccctggaagcatccaggaagtcagcctaaaactgcttgtaccaattgctattgtaaaaagtgttgctttcattgccaagtttgtttcatgacaaaagccttaggcatctcctatggcaggaagaagcggagacagcgacgaagagctcatcagaacagtcagactcatcaagcttctctatcaaagcagtaagtagtacatgtaatgcaacctataatagtagcaatagtagcattagtagtagcaataataatagcaatagttgtgtggtccatagtaatcatagaatataggaaaatggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatccttggcacttatctgggacgatctgcggagcctgtgcctcttcagctaccaccgcttgagagacttactcttgattgtaacgaggattgtggaacttctgggacgcagggggtgggaagccctcaaatattggtggaatctcctacaatattggagtcaggagctaaagaatagtgctgttagcttgctcaatgccacagccatagcagtagctgaggggacagatagggttatagaagtagtacaaggagcttgtagagctattcgccacatacctagaagaataagacagggcttggaaaggattttgctataagctcgaggccgccccggtgaccttcagaccttggcactggaggtggcccggcagaagcgcggcatcgtggatcagtgctgcaccagcatctgctctctctaccaactggagaactactgcaactaggcccaccactaccctgtccacccctctgcaatgaataaaacctttgaaagagcactacaagttgtgtgtacatgcgtgcatgtgcatatgtggtgcggggggaacatgagtggggctggctggagtggcgatgataagctgtcaaacatgagaattaattcttgaagacgaaagggcctcgtgatacgcctatttttataggttaatgtcatgataataatggtttcttagtctagaattaattccgtgtattctatagtgtcacctaaatcgtatgtgtatgatacataaggttatgtattaattgtagccgcgttctaacgacaatatgtacaagcctaattgtgtagcatctggcttactgaagcagaccctatcatctctctcgtaaactgccgtcagagtcggtttggttggacgaaccttctgagtttctggtaacgccgtcccgcacccggaaatggtcagcgaaccaatcagcagggtcatcgctagccagatcctctacgccggacgcatcgtggccggcatcaccggcgccacaggtgcggttgctggcgcctatatcgccgacatcaccgatggggaagatcgggctcgccacttcgggctcatgagcgcttgtttcggcgtgggtatggtggcaggccccgtggccgggggactgttgggcgccatctccttgcatgcaccattccttgcggcggcggtgctcaacggcctcaacctactactgggctgcttcctaatgcaggagtcgcataagggagagcgtcgaatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcacatgagcgaaaaatacatcgtcacctgggacatgttgcagatccatgcacgtaaactcgcaagccgactgatgccttctgaacaatggaaaggcattattgccgtaagccgtggcggtctgtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaatcttttcaacgcctggcactgccgggcgttgttctttttaacttcaggcgggttacaatagtttccagtaagtattctggaggctgcatccatgacacaggcaaacctgagcgaaaccctgttcaaaccccgctttaaacatcctgaaacctcgacgctagtccgccgctttaatcacggcgcacaaccgcctgtgcagtcggcccttgatggtaaaaccatccctcactggtatcgcatgattaaccgtctgatgtggatctggcgcggcattgacccacgcgaaatcctcgacgtccaggcacgtattgtgatgagcgatgccgaacgtaccgacgatgatttatacgatacggtgattggctaccgtggcggcaactggatttatgagtgggccccggatctttgtgaaggaaccttacttctgtggtgtgacataattggacaaactacctacagagatttaaagctctaaggtaaatataaaatttttaacccggatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccaaaaaagaagagaaaggtagaagaccccaaggactttccttcagaattgctaagttttttgagtcatgctgtgtttagtaatagaactcttgcttgctttgctatttacaccacaaaggaaaaagctgcactgctatacaagaaaattatggaaaaatattctgtaacctttataagtaggcataacagttataatcataacatactgttttttcttactccacacaggcatagagtgtctgctattaataactatgctcaaaaattgtgtacctttagctttttaatttgtaaaggggttaataaggaatatttgatgtatagtgccttgactagagatcataatcagccataccacatttgtagaggttttacttgctttaaaaaacctcccacacctccccctgaacctgaaacataaaatgaatgcaattgttgttgttgggctgcaggaattaattcgagctcgcccgaca

SEQ ID NO: 52 - DNA, 7586 bp, Artificial sequence
  SEQ ID NO: 52
gcggccgctctagagagcttggcccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccggtcgaccgatcctgagaacttcagggtgagtttggggacccttgattgttctttctttttcgctattgtaaaattcatgttatatggagggggcaaagttttcagggtgttgtttagaatgggaagatgtcccttgtatcaccatggaccctcatgataattttgtttctttcactttctactctgttgacaaccattgtctcctcttattttcttttcattttctgtaactttttcgttaaactttagcttgcatttgtaacgaatttttaaattcacttttgtttatttgtcagattgtaagtactttctctaatcacttttttttcaaggcaatcagggtatattatattgtacttcagcacagttttagagaacaattgttataattaaatgataaggtagaatatttctgcatataaattctggctggcgtggaaatattcttattggtagaaacaactacaccctggtcatcatcctgcctttctctttatggttacaatgatatacactgtttgagatgaggataaaatactctgagtccaaaccgggcccctctgctaaccatgttcatgccttcttctctttcctacagctcctgggcaacgtgctggttgttgtgctgtctcatcattttggcaaagaattcctcgacggatctgtcgaggtcgacggtatcgataagcttgatcatgaatataccttgctttgctgtgatcctcagcttagctactacacattctctgggagaattccccttgtatacgattcccgagaaaatagagaaatggacccccatagacatgatccatcttagttgccctaataacatgctgtctgaggaagaaggttgcaatacagagtctcctttcacctacttcgagctcaagagtggttacctagcccatcagaaggtcccaggatttacatgcactggggttgtgaatgaggcagagacatacacaaactttgtcggatatgtcaccaccaccttcaaaaggaagcactttaaacctacagtggctgcttgtcgtgatgcctacaactggaaagtatcaggggacccccgatatgaagaatctctacacaccccgtatcccgacagcagctggttaaggactgtgaccacaaccaaagaagcccttcttataatatcgccaagcattgtagagatggacatatatggcaggacccttcactctcccatgttcccttcggggaaatgttccaagctctatccttctgtcccctcttgtacaaccaaccatgattacacattgtggttgccagaagattctagtctgagtttgatttgcgacatcttcacttccagcagtggacagaaggccatgaatgggtctcgcatctgcggattcaaggatgaaaggggattttacagatccttgaagggatcctgtaagctgacattgtgcgggaaacctggaattaggctgttcgacggaacttgggtctcttttacaaagccggacgttcatgtgtggtgcactcccaaccagttagtcaatatacataacgacagactagatgaggttgaacatctgatcgtggacgatatcatcaagaagagagaggagtgtttagacacgctggaaactatacttatgtctcaatcagttagttttagacggttgagccatttcagaaagttagttccaggatatggaaaagcttacactattttgaacggcagcttaatggaaacaaatgtctactacaaaagagttgacaggtgggcggacattttgccttctaggggatgtctgaaagtcggacaacagtgcatggaccctgtcaaaggggtcctcttcaacggaattatcaagggtccggatggacaaatattgattccagagatgcagtcagagcagctcaaacagcatatggatctgttgaaagcagctatgtttcctctccgtcatcctttaatcaacagagaggcagtcttcaagaaggatggaaatgccgatgattttgttgatctccatatgcctgatgttcaaaaatctgtgtcggatgtcgacctgggcctgcctcattgggggttctggttgttagtcggggcaacagtagtagcctttgtggtcttggcgtgcttgctccgtgtatgttgtaggagaatgagaaggagaaggtcactgcgtgccactcaggatatccccctcagcgttgcccctgcccctgtccctcgtgccaaagtggtgtcatcatgggagtcttctaaagggctcccaggtacttgatgtgtctatatgtgattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaaacgtctaggccccccgaaccacggggacgtggttttcctttgaaaaacacgatgataagctcaagcttaccatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctgactttatcatactgcctgacacatagatcacaacctgattacctgcctcggcacagatccactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacggatcggccgcaattcgtaatcatgtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcgggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattggagctccaccgcggtg

SEQ ID NO: 53 - DNA, 10570 bp, Artificial sequence
  SEQ ID NO: 53
ccagatcctctacgccggacgcatcgtggccggcatcaccggcgccacaggtgcggttgctggcgcctatatcgccgacatcaccgatggggaagatcgggctcgccacttcgggctcatgagcgcttgtttcggcgtgggtatggtggcaggccccgtggccgggggactgttgggcgccatctccttgcatgcaccattccttgcggcggcggtgctcaacggcctcaacctactactgggctgcttcctaatgcaggagtcgcataagggagagcgtcgaatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcacatgagcgaaaaatacatcgtcacctgggacatgttgcagatccatgcacgtaaactcgcaagccgactgatgccttctgaacaatggaaaggcattattgccgtaagccgtggcggtctgtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaatcttttcaacgcctggcactgccgggcgttgttctttttaacttcaggcgggttacaatagtttccagtaagtattctggaggctgcatccatgacacaggcaaacctgagcgaaaccctgttcaaaccccgctttaaacatcctgaaacctcgacgctagtccgccgctttaatcacggcgcacaaccgcctgtgcagtcggcccttgatggtaaaaccatccctcactggtatcgcatgattaaccgtctgatgtggatctggcgcggcattgacccacgcgaaatcctcgacgtccaggcacgtattgtgatgagcgatgccgaacgtaccgacgatgatttatacgatacggtgattggctaccgtggcggcaactggatttatgagtgggccccggatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccaaaaaagaagagaaaggtagaagaccccaaggactttccttcagaattgctaagttttttgagtcatgctgtgtttagtaatagaactcttgcttgctttgctatttacaccacaaaggaaaaagctgcactgctatacaagaaaattatggaaaaatattctgtaacctttataagtaggcataacagttataatcataacatactgttttttcttactccacacaggcatagagtgtctgctattaataactatgctcaaaaattgtgtacctttagctttttaatttgtaaaggggttaataaggaatatttgatgtatagtgccttgactagagatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatcaactggataactcaagctaaccaaaatcatcccaaacttcccaccccataccctattaccactgccaattacctagtggtttcatttactctaaacctgtgattcctctgaattattttcattttaaagaaattgtatttgttaaatatgtactacaaacttagtagttggaagggctaattcactcccaacgaagacaagatatccttgatctgtggatctaccacacacaaggctacttccctgattagcagaactacacaccagggccagggatcagatatccactgacctttggatggtgctacaagctagtaccagttgagccagagaagttagaagaagccaacaaaggagagaacaccagcttgttacaacctgtgagcctgcatgggatggatgacccggagagagaagtgttagagtggaggtttgacagccgcctagcatttcatcacggtggcccgagagctgcatccggagtacttcaagaactgctgatatcgagcttgctacaagggactttccgctgggggactttccagggaggcgtggcctgggcgggactggggagtggcgagccctcagatcctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctagcaccgtcgacgaattcacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccactttggctgatacgcgtattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagcttggtaccgagctcggatcgatagcttaagcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcggaattcagtggatccactagtagtggccaggatccgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcatcggggtacctttaagaccaatgacttacaaggcagctgtagatcttagccactttttaaaagaaaaggggggactggaagggctaattcactcccaacgaagacaagatcgtcgagagatgctgcatataagcagctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtagtagttcatgtcatcttattattcagtatttataacttgcaaagaaatgaatatcagagagtgagaggccttgacattataatagatttagcaggaattgaactaggagtggagcacacaggcaaagctgcagaagtacttggaagaagccaccagagatactcacgattctgcacatacctggctaatcccagatcctaaggattacattaagtttactaacatttatataatgatttatagtttaaagtataaacttatctaatttactattctgacagatattaattaatcctcaaatatcataagagatgattactattatccccatttaacacaagaggaaactgagagggaaagatgttgaagtaattttcccacaattacagcatccgttagttacgactctatgatcttctgacacaaattccatttactcctcaccctatgactcagtcgaatatatcaaagttatggacattatgctaagtaacaaattacccttttatatagtaaatactgagtagattgagagaagaaattgtttgcaaacctgaatagcttcaagaagaagagaagtgaggataagaataacagttgtcatttaacaagttttaacaagtaacttggttagaaagggattcaaatgcataaagcaagggataaatttttctggcaacaagactatacaatataaccttaaatatgacttcaaataattgttggaacttgataaaactaattaaatattattgaagattatcaatattataaatgtaatttacttttaaaaagggaacatagaaatgtgtatcattagagtagaaaacaatccttattatcacaatttgtcaaaacaagtttgttattaacacaagtagaatactgcattcaattaagttgactgcagattttgtgttttgttaaaattagaaagagataacaacaatttgaattattgaaagtaacatgtaaatagttctacatacgttcttttgacatcttgttcaatcattgatcgaagttctttatcttggaagaatttgttccaaagactctgaaataaggaaaacaatctattatatagtctcacacctttgttttacttttagtgatttcaatttaataatgtaaatggttaaaatttattcttctctgagatcatttcacattgcagatagaaaacctgagactggggtaatttttattaaaatctaatttaatctcagaaacacatctttattctaacatcaatttttccagtttgatattatcatataaagtcagccttcctcatctgcaggttccacaacaaaaatccaaccaactgtggatcaaaaatattgggaaaaaattaaaaatagcaatacaacaataaaaaaatacaaatcagaaaaacagcacagtataacaactttatttagcatttacaatctattaggtattataagtaatctag

SEQ ID NO: 54 - DNA, 13784 bp, Artificial sequence
  SEQ ID NO: 54
cagttagagaaagaacccataataggagcagaaactttctatgtagatggggcagccaatagggaaactaaattaggaaaagcaggatatgtaactgacagaggaagacaaaaagttgtccccctaacggacacaacaaatcagaagactcagttacaagcaattcatctagctttgcaggattcgggattagaagtaaacatagtgacagactcacaatatgcattgggaatcattcaagcacaaccagataagagtgaatcagagttagtcagtcaaataatagagcagttaataaaaaaggaaaaagtctacctggcatgggtaccagcacacaaaggaattggaggaaatgaacaagtagataaattggtcagtgctggaatcaggaaagtactatttttagatggaatagataaggcccaagaagaacatgagaaatatcacagtaattggagagcaatggctagtgattttaacctaccacctgtagtagcaaaagaaatagtagccagctgtgataaatgtcagctaaaaggggaagccatgcatggacaagtagactgtagcccaggaatatggcagctagattgtacacatttagaaggaaaagttatcttggtagcagttcatgtagccagtggatatatagaagcagaagtaattccagcagagacagggcaagaaacagcatacttcctcttaaaattagcaggaagatggccagtaaaaacagtacatacagacaatggcagcaatttcaccagtactacagttaaggccgcctgttggtgggcggggatcaagcaggaatttggcattccctacaatccccaaagtcaaggagtaatagaatctatgaataaagaattaaagaaaattataggacaggtaagagatcaggctgaacatcttaagacagcagtacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggaaaggaccagcaaagctcctctggaaaggtgaaggggcagtagtaatacaagataatagtgacataaaagtagtgccaagaagaaaagcaaagatcatcagggattatggaaaacagatggcaggtgatgattgtgtggcaagtagacaggatgaggattaacacatggaattctgcaacaactgctgtttatccatttcagaattgggtgtcgacatagcagaataggcgttactcgacagaggagagcaagaaatggagccagtagatcctagactagagccctggaagcatccaggaagtcagcctaaaactgcttgtaccaattgctattgtaaaaagtgttgctttcattgccaagtttgtttcatgacaaaagccttaggcatctcctatggcaggaagaagcggagacagcgacgaagagctcatcagaacagtcagactcatcaagcttctctatcaaagcagtaagtagtacatgtaatgcaacctataatagtagcaatagtagcattagtagtagcaataataatagcaatagttgtgtggtccatagtaatcatagaatataggaaaatggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatccttggcacttatctgggacgatctgcggagcctgtgcctcttcagctaccaccgcttgagagacttactcttgattgtaacgaggattgtggaacttctgggacgcagggggtgggaagccctcaaatattggtggaatctcctacaatattggagtcaggagctaaagaatagtgctgttagcttgctcaatgccacagccatagcagtagctgaggggacagatagggttatagaagtagtacaaggagcttgtagagctattcgccacatacctagaagaataagacagggcttggaaaggattttgctataagctcgaggccgccccgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaaacgtctaggccccccgaaccacggggacgtggttttcctttgaaaaacacgatgataagcttgccacaacccgtaccaaagatggatagatccggaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagcggtgaccttcagaccttggcactggaggtggcccggcagaagcgcggcatcgtggatcagtgctgcaccagcatctgctctctctaccaactggagaactactgcaactaggcccaccactaccctgtccacccctctgcaatgaataaaacctttgaaagagcactacaagttgtgtgtacatgcgtgcatgtgcatatgtggtgcggggggaacatgagtggggctggctggagtggcgatgataagctgtcaaacatgagaattaattcttgaagacgaaagggcctcgtgatacgcctatttttataggttaatgtcatgataataatggtttcttagtctagaattaattccgtgtattctatagtgtcacctaaatcgtatgtgtatgatacataaggttatgtattaattgtagccgcgttctaacgacaatatgtacaagcctaattgtgtagcatctggcttactgaagcagaccctatcatctctctcgtaaactgccgtcagagtcggtttggttggacgaaccttctgagtttctggtaacgccgtcccgcacccggaaatggtcagcgaaccaatcagcagggtcatcgctagccagatcctctacgccggacgcatcgtggccggcatcaccggcgccacaggtgcggttgctggcgcctatatcgccgacatcaccgatggggaagatcgggctcgccacttcgggctcatgagcgcttgtttcggcgtgggtatggtggcaggccccgtggccgggggactgttgggcgccatctccttgcatgcaccattccttgcggcggcggtgctcaacggcctcaacctactactgggctgcttcctaatgcaggagtcgcataagggagagcgtcgaatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcacatgagcgaaaaatacatcgtcacctgggacatgttgcagatccatgcacgtaaactcgcaagccgactgatgccttctgaacaatggaaaggcattattgccgtaagccgtggcggtctgtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaatcttttcaacgcctggcactgccgggcgttgttctttttaacttcaggcgggttacaatagtttccagtaagtattctggaggctgcatccatgacacaggcaaacctgagcgaaaccctgttcaaaccccgctttaaacatcctgaaacctcgacgctagtccgccgctttaatcacggcgcacaaccgcctgtgcagtcggcccttgatggtaaaaccatccctcactggtatcgcatgattaaccgtctgatgtggatctggcgcggcattgacccacgcgaaatcctcgacgtccaggcacgtattgtgatgagcgatgccgaacgtaccgacgatgatttatacgatacggtgattggctaccgtggcggcaactggatttatgagtgggccccggatctttgtgaaggaaccttacttctgtggtgtgacataattggacaaactacctacagagatttaaagctctaaggtaaatataaaatttttaacccggatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccaaaaaagaagagaaaggtagaagaccccaaggactttccttcagaattgctaagttttttgagtcatgctgtgtttagtaatagaactcttgcttgctttgctatttacaccacaaaggaaaaagctgcactgctatacaagaaaattatggaaaaatattctgtaacctttataagtaggcataacagttataatcataacatactgttttttcttactccacacaggcatagagtgtctgctattaataactatgctcaaaaattgtgtacctttagctttttaatttgtaaaggggttaataaggaatatttgatgtatagtgccttgactagagatcataatcagccataccacatttgtagaggttttacttgctttaaaaaacctcccacacctccccctgaacctgaaacataaaatgaatgcaattgttgttgttgggctgcaggaattaattcgagctcgcccgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagagtctataggcccacccccttggcttcttatgcgacggatcgatcccgtaataagcttcgaggtccgcggccggccgcgttgacgcgcacggcaagaggcgaggggcggcgactggtgagagatgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaataaagataggggggcaattaaaggaagctctattagatacaggagcagatgatacagtattagaagaaatgaatttgccaggaagatggaaaccaaaaatgatagggggaattggaggttttatcaaagtaagacagtatgatcagatactcatagaaatctgcggacataaagctataggtacagtattagtaggacctacacctgtcaacataattggaagaaatctgttgactcagattggctgcactttaaattttcccattagtcctattgagactgtaccagtaaaattaaagccaggaatggatggcccaaaagttaaacaatggccattgacagaagaaaaaataaaagcattagtagaaatttgtacagaaatggaaaaggaaggaaaaatttcaaaaattgggcctgaaaatccatacaatactccagtatttgccataaagaaaaaagacagtactaaatggagaaaattagtagatttcagagaacttaataagagaactcaagatttctgggaagttcaattaggaataccacatcctgcagggttaaaacagaaaaaatcagtaacagtactggaggtgggcgatgcatatttttcagttcccttagataaagacttcaggaagtatactgcatttaccatacctagtataaacaatgagacaccagggattagatatcagtacaatgtgcttccacagggatggaaaggatcaccagcaatattccagtgtagcatgacaaaaatcttagagccttttagaaaacaaaatccagacatagtcatctatcaatacatggatgatttgtatgtaggatctgacttagaaatagggcagcatagaacaaaaatagaggaactgagacaacatctgttgaggtggggatttaccacaccagacaaaaaacatcagaaagaacctccattcctttggatgggttatgaactccatcctgataaatggacagtacagcctatagtgctgccagaaaaggacagctggactgtcaatgacatacagaaattagtgggaaaattgaattgggcaagtcagatttatgcagggattaaagtaaggcaattatgtaaacttcttaggggaaccaaagcactaacagaagtagtaccactaacagaagaagcagagctagaactggcagaaaacagggagattctaaaagaaccggtacatggagtgtattatgacccatcaaaagacttaatagcagaaatacagaagcaggggcaaggccaatggacatatcaaatttatcaagagccatttaaaaatctgaaaacaggaaagtatgcaagaatgaagggtgcccacactaatgatgtgaaacaattaacagaggcagtacaaaaaatagccacagaaagcatagtaatatggggaaagactcctaaatttaaattacccatacaaaaggaaacatgggaagcatggtggacagagtattggcaagccacctggattcctgagtgggagtttgtcaatacccctcccttagtgaagttatggtac

SEQ ID NO: 55 - DNA, 13862 bp, Artificial sequence
  SEQ ID NO: 55
tcaatattggccattagccatattattcattggttatatagcataaatcaatattggctattggccattgcatacgttgtatctatatcataatatgtacatttatattggctcatgtccaatatgaccgccatgttggcattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcactagaagctttattgcggtagtttatcacagttaaattgctaacgcagtcagtgcttctgacacaacagtctcgaacttaagctgcagaagttggtcgtgaggcactgggcaggtaagtatcaaggttacaagacaggtttaaggagaccaatagaaactgggcttgtcgagacagagaagactcttgcgtttctgataggcacctattggtcttactgacatccactttgcctttctctccacaggtgtccactcccagttcaattacagctcttaaggctagagtacttaatacgactcactataggcgagtttactccctatcagtgatagagaacgtatgtcgagtttactccctatcagtgatagagaacgatgtcgagtttactccctatcagtgatagagaacgtatgtcgagtttactccctatcagtgatagagaacgtatgtcgagtttactccctatcagtgatagagaacgtatgtcgagtttatccctatcagtgatagagaacgtatgtcgagtttactccctatcagtgatagagaacgtatgtcgaggtaggcgtgtacggtgggaggcctatataagcagagctcgtttagtgaaccgtcagatcgcctggatgaagtgccttttgtacttagcctttttattcattggggtgaattgcaagttcaccatagtttttccacacaaccaaaaaggaaactggaaaaatgttccttctaattaccattattgcccgtcaagctcagatttaaattggcataatgacttaataggcacagccatacaagtcaaaatgcccaagagtcacaaggctattcaagcagacggttggatgtgtcatgcttccaaatgggtcactacttgtgatttccgctggtatggaccgaagtatataacacagtccatccgatccttcactccatctgtagaacaatgcaaggaaagcattgaacaaacgaaacaaggaacttggctgaatccaggcttccctcctcaaagttgtggatatgcaactgtgacggatgccgaagcagtgattgtccaggtgactcctcaccatgtgctggttgatgaatacacaggagaatgggttgattcacagttcatcaacggaaaatgcagcaattacatatgccccactgtccataactctacaacctggcattctgactataaggtcaaagggctatgtgattctaacctcatttccatggacatcaccttcttctcagaggacggagagctatcatccctgggaaaggagggcacagggttcagaagtaactactttgcttatgaaactggaggcaaggcctgcaaaatgcaatactgcaagcattggggagtcagactcccatcaggtgtctggttcgagatggctgataaggatctctttgctgcagccagattccctgaatgcccagaagggtcaagtatctctgctccatctcagacctcagtggatgtaagtctaattcaggacgttgagaggatcttggattattccctctgccaagaaacctggagcaaaatcagagcgggtcttccaatctctccagtggatctcagctatcttgctcctaaaaacccaggaaccggtcctgctttcaccataatcaatggtaccctaaaatactttgagaccagatacatcagagtcgatattgctgctccaatcctctcaagaatggtcggaatgatcagtggaactaccacagaaagggaactgtgggatgactgggcaccatatgaagacgtggaaattggacccaatggagttctgaggaccagttcaggatataagtttcctttatacatgattggacatggtatgttggactccgatcttcatcttagctcaaaggctcaggtgttcgaacatcctcacattcaagacgctgcttcgcaacttcctgatgatgagagtttattttttggtgatactgggctatccaaaaatccaatcgagcttgtagaaggttggttcagtagttggaaaagctctattgcctcttttttctttatcatagggttaatcattggactattcttggttctccgagttggtatccatctttgcattaaattaaagcacaccaagaaaagacagatttatacagacatagagatgaaccgagaaggatccgcggccgcgccggctctagatcgcgaacgcgtgaattctaccgggtaggggaggcgcttttcccaaggcagtctggagcatgcgctttagcagccccgctgggcacttggcgctacacaagtggcctctggcctcgcacacattccacatccaccggtaggcgccaaccggctccgttctttggtggccccttcgcgccaccttctactcctcccctagtcaggaagttcccccccgccccgcagctcgcgtcgtgcaggacgtgacaaatggaagtagcacgtctcactagtctcgtgcagatggacagcaccgctgagcaatggaagcgggtaggcctttggggcagcggccaatagcagctttgctccttcgctttctgggctcagaggctgggaaggggtgggtccgggggcgggctcaggggcgggctcaggggcggggcgggcgcccgaaggtcctccggaggcccggcattctgcacgcttcaaaagcgcacgtctgccgcgctgttctcctcttcctcatctccgggcctttcgtatgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaataaagataggggggcaattaaaggaagctctattagatacaggagcagatgatacagtattagaagaaatgaatttgccaggaagatggaaaccaaaaatgatagggggaattggaggttttatcaaagtaagacagtatgatcagatactcatagaaatctgcggacataaagctataggtacagtattagtaggacctacacctgtcaacataattggaagaaatctgttgactcagattggctgcactttaaattttcccattagtcctattgagactgtaccagtaaaattaaagccaggaatggatggcccaaaagttaaacaatggccattgacagaagaaaaaataaaagcattagtagaaatttgtacagaaatggaaaaggaaggaaaaatttcaaaaattgggcctgaaaatccatacaatactccagtatttgccataaagaaaaaagacagtactaaatggagaaaattagtagatttcagagaacttaataagagaactcaagatttctgggaagttcaattaggaataccacatcctgcagggttaaaacagaaaaaatcagtaacagtactggaggtgggcgatgcatatttttcagttcccttagataaagacttcaggaagtatactgcatttaccatacctagtataaacaatgagacaccagggattagatatcagtacaatgtgcttccacagggatggaaaggatcaccagcaatattccagtgtagcatgacaaaaatcttagagccttttagaaaacaaaatccagacatagtcatctatcaatacatggatgatttgtatgtaggatctgacttagaaatagggcagcatagaacaaaaatagaggaactgagacaacatctgttgaggtggggatttaccacaccagacaaaaaacatcagaaagaacctccattcctttggatgggttatgaactccatcctgataaatggacagtacagcctatagtgctgccagaaaaggacagctggactgtcaatgacatacagaaattagtgggaaaattgaattgggcaagtcagatttatgcagggattaaagtaaggcaattatgtaaacttcttaggggaaccaaagcactaacagaagtagtaccactaacagaagaagcagagctagaactggcagaaaacagggagattctaaaagaaccggtacatggagtgtattatgacccatcaaaagacttaatagcagaaatacagaagcaggggcaaggccaatggacatatcaaatttatcaagagccatttaaaaatctgaaaacaggaaagtatgcaagaatgaagggtgcccacactaatgatgtgaaacaattaacagaggcagtacaaaaaatagccacagaaagcatagtaatatggggaaagactcctaaatttaaattacccatacaaaaggaaacatgggaagcatggtggacagagtattggcaagccacctggattcctgagtgggagtttgtcaatacccctcccttagtgaagttatggtaccagttagagaaagaacccataataggagcagaaactttctatgtagatggggcagccaatagggaaactaaattaggaaaagcaggatatgtaactgacagaggaagacaaaaagttgtccccctaacggacacaacaaatcagaagactcagttacaagcaattcatctagctttgcaggattcgggattagaagtaaacatagtgacagactcacaatatgcattgggaatcattcaagcacaaccagataagagtgaatcagagttagtcagtcaaataatagagcagttaataaaaaaggaaaaagtctacctggcatgggtaccagcacacaaaggaattggaggaaatgaacaagtagataaattggtcagtgctggaatcaggaaagtactatttttagatggaatagataaggcccaagaagaacatgagaaatatcacagtaattggagagcaatggctagtgattttaacctaccacctgtagtagcaaaagaaatagtagccagctgtgataaatgtcagctaaaaggggaagccatgcatggacaagtagactgtagcccaggaatatggcagctagattgtacacatttagaaggaaaagttatcttggtagcagttcatgtagccagtggatatatagaagcagaagtaattccagcagagacagggcaagaaacagcatacttcctcttaaaattagcaggaagatggccagtaaaaacagtacatacagacaatggcagcaatttcaccagtactacagttaaggccgcctgttggtgggcggggatcaagcaggaatttggcattccctacaatccccaaagtcaaggagtaatagaatctatgaataaagaattaaagaaaattataggacaggtaagagatcaggctgaacatcttaagacagcagtacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggaaaggaccagcaaagctcctctggaaaggtgaaggggcagtagtaatacaagataatagtgacataaaagtagtgccaagaagaaaagcaaagatcatcagggattatggaaaacagatggcaggtgatgattgtgtggcaagtagacaggatgaggattaacacatggaattctgcaacaactgctgtttatccatttcagaattgggtgtcgacatagcagaataggcgttactcgacagaggagagcaagaaatggagccagtagatcctagactagagccctggaagcatccaggaagtcagcctaaaactgcttgtaccaattgctattgtaaaaagtgttgctttcattgccaagtttgtttcatgacaaaagccttaggcatctcctatggcaggaagaagcggagacagcgacgaagagctcatcagaacagtcagactcatcaagcttctctatcaaagcagtaagtagtacatgtaatgcaacctataatagtagcaatagtagcattagtagtagcaataataatagcaatagttgtgtggtccatagtaatcatagaatataggaaaatggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatccttggcacttatctgggacgatctgcggagcctgtgcctcttcagctaccaccgcttgagagacttactcttgattgtaacgaggattgtggaacttctgggacgcagggggtgggaagccctcaaatattggtggaatctcctacaatattggagtcaggagctaaagaatagtgctgttagcttgctcaatgccacagccatagcagtagctgaggggacagatagggttatagaagtagtacaaggagcttgtagagctattcgccacatacctagaagaataagacagggcttggaaaggattttgctatcctgcagctgtctatatgtgattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaaacgtctaggccccccgaaccacggggacgtggttttcctttgaaaaacacgatgataagctcaagcttaccatggatagatccggaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaataggagaattcacgcgtggtacctctagagtcgacccgggcggccgcttcgagcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggagatgtgggaggttttttaaagcaagtaaaacctctacaaatgtggtaaaatcgataaggatccgggctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatggctcgacagatct

SEQ ID NO: 56 - DNA, 5744 bp, Artificial sequence
  SEQ ID NO: 56
tagactggacaagagcaaagtcataaacggcgctctggaattactcaatggagtcggtatcgaaggcctgacgacaaggaaactcgctcaaaagctgggagttgagcagcctaccctgtactggcacgtgaagaacaagcgggccctgctcgatgccctgccaatcgagatgctggacaggcatcatacccacttctgccccctggaaggcgagtcatggcaagactttctgcggaacaacgccaagtcattccgctgtgctctcctctcacatcgcgacggggctaaagtgcatctcggcacccgcccaacagagaaacagtacgaaaccctggaaaatcagctcgcgttcctgtgtcagcaaggcttctccctggagaacgcactgtacgctctgtccgccgtgggccactttacactgggctgcgtattggaggaacaggagcatcaagtagcaaaagaggaaagagagacacctaccaccgattctatgcccccacttctgagacaagcaattgagctgttcgaccggcagggagccgaacctgccttccttttcggcctggaactaatcatatgtggcctggagaaacagctaaagtgcgaaagcggcgggccggccgacgcccttgacgattttgacttagacatgctcccagccgatgcccttgacgactttgaccttgatatgctgcctgctgacgctcttgacgattttgaccttgacatgctccccgggtaaactagaagctttattgcggtagtttatcacagttaaattgctaacgcagtcagtgcttctgacacaacagtctcgaacttaagctgcatgtctatatgtgattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaaacgtctaggccccccgaaccacggggacgtggttttcctttgaaaaacacgatgataagctcaagcttaccatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctgagaagttggtcgtgaggcactgggcaggtaagtatcaaggttacaagacaggtttaaggagaccaatagaaactgggcttgtcgagacagagaagactcttgcgtttctgataggcacctattggtcttactgacatccactttgcctttctctccacaggtgtccactcccagttcaattacagctcttaaggctagagtacttaatacgactcactataggctagcctcgagaattcacgcgtggtacctctagagtcgacccgggcggccgcttcgagcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggagatgtgggaggttttttaaagcaagtaaaacctctacaaatgtggtaaaatcgataaggatccgggctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatggctcgacagatctaagcttgggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgactctactagaggatccaccatgtc

SEQ ID NO: 57 - DNA, 6686 bp, Artificial sequence
  SEQ ID NO: 57
tttgaaagaccccacccgtaggtggcaagctagcttaagtaacgccactttgcaaggcatggaaaaatacataactgagaatagaaaagttcagatcaaggtcaggaacaaagaaacagctgaataccaaacaggatatctgtggtaagcggttcctgccccggctcagggccaagaacagatgagacagctgagtgatgggccaaacaggatatctgtggtaagcagttcctgccccggctcggggccaagaacagatggtccccagatgcggtccagccctcagcagtttctagtgaatcatcagatgtttccagggtgccccaaggacctgaaaatgaccctgtaccttatttgaactaaccaatcagttcgcttctcgcttctgttcgcgcgcttccgctctccgagctcaataaaagagcccacaacccctcactcggcgcgccagtcttccgatagactgcgtcgcccgggtacccgtattcccaataaagcctcttgctgtttgcatccgaatcgtggtctcgctgttccttgggagggtctcctctgagtgattgactacccacgacgggggtctttcatttgggggctcgtccgggatttggagacccctgcccagggaccaccgacccaccaccgggaggtaagctggccagcaacttatctgtgtctgtccgattgtctagtgtctatgtttgatgttatgcgcctgcgtctgtactagttagctaactagctctgtatctggcggacccgtggtggaactgacgagttctgaacacccggccgcaaccctgggagacgtcccagggactttgggggccgtttttgtggcccgacctgaggaagggagtcgatgtggaatccgaccccgtcaggatatgtggttctggtaggagacgagaacctaaaacagttcccgcctccgtctgaatttttgctttcggtttggaaccgaagccgcgcgtcttgtctgctgcagcgctgcagcatcgttctgtgttgtctctgtctgactgtgtttctgtatttgtctgaaaattagggccagactgttaccactcccttaagtttgaccttaggtcactggaaagatgtcgagcggatcgctcacaaccagtcggtagatgtcaagaagagacgttgggttaccttctgctctgcagaatggccaacctttaacgtcggatggccgcgagacggcacctttaaccgagacctcatcacccaggttaagatcaaggtcttttcacctggcccgcatggacacccagaccaggtcccctacatcgtgacctgggaagccttggcttttgacccccctccctgggtcaagccctttgtacaccctaagcctccgcctcctcttcctccatccgccccgtctctcccccttgaacctcctcgttcgaccccgcctcgatcctccctttatccagccctcactccttctctaggcgccggaattcgtttaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatccgctagcgctaccggactcagatctcgagctcaagcttcgaattctgcagtcgacggtaccgcgggcccgggatccaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtaaagcggccgcgactctagatcataatcagccataactagtagtggccaggatccgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcatcgggaataaaagattttatttagtctccagaaaaaggggggaatgaaagaccccacctgtaggtttggcaagctagcttaagtaacgccattttgcaaggcatggaaaaatacataactgagaatagagaagttcagatcaaggtcaggaacagatggaacagctgaatatgggccaaacaggatatctgtggtaagcagttcctgccccggctcagggccaagaacagatggaacagctgaatatgggccaaacaggatatctgtggtaagcagttcctgccccggctcagggccaagaacagatggtccccagatgcggtccagccctcagcagtttctagagaaccatcagatgtttccagggtgccccaaggacctgaaatgaccctgtgccttatttgaactaaccaatcagttcgcttctcgcttctgttcgcgcgcttctgctccccgagctcaataaaagagcccacaacccctcactcggggcgccagtcctccgattgactgagtcgcccgggtacccgtgtatccaataaaccctcttgcagttgcatccgacttgtggtctcgctgttccttgggagggtctcctctgagtgattgactacccgtcagcgggggtctttcatttgggggctcgtccgggatcgggagacccctgcccagggaccaccgacccaccaccgggaggtaagctggctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaagaattgctagcaattgctagcaattgctagcaattcataccagatcaccgaaaactgtcctccaaatgtgtccccctcacactcccaaattcgcgggcttctgcctcttagaccactctaccctattccccacactcaccggagccaaagccgcggcccttccgtttctttgct

SEQ ID NO: 58 - DNA, 11462 bp, Artificial sequence
  SEQ ID NO: 58
ttgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagagtctataggcccacccccttggcttcttatgcgacggatcgatcccgtaataagcttcgaggtccgcggccggccgcgttgacgcgcacggcaagaggcgaggggcggcgactggtgagagatgggccagactgttaccactcccttaagtttgaccttaggtcactggaaagatgtcgagcggatcgctcacaaccagtcggtagatgtcaagaagagacgttgggttaccttctgctctgcagaatggccaacctttaacgtcggatggccgcgagacggcacctttaaccgagacctcatcacccaggttaagatcaaggtcttttcacctggcccgcatggacacccagaccaggtcccctacatcgtgacctgggaagccttggcttttgacccccctccctgggtcaagccctttgtacaccctaagcctccgcctcctcttcctccatccgccccgtctctcccccttgaacctcctcgttcgaccccgcctcgatcctccctttatccagccctcactccttctctaggcgccaaacctaaacctcaagttctttctgacagtggggggccgctcatcgacctacttacagaagaccccccgccttatagggacccaagaccacccccttccgacagggacggaaatggtggagaagcgacccctgcgggagaggcaccggacccctccccaatggcatctcgcctacgtgggagacgggagccccctgtggccgactccactacctcgcaggcattccccctccgcgcaggaggaaacggacagcttcaatactggccgttctcctcttctgacctttacaactggaaaaataataacccttctttttctgaagatccaggtaaactgacagctctgatcgagtctgttctcatcacccatcagcccacctgggacgactgtcagcagctgttggggactctgctgaccggagaagaaaaacaacgggtgctcttagaggctagaaaggcggtgcggggcgatgatgggcgccccactcaactgcccaatgaagtcgatgccgcttttcccctcgagcgcccagactgggattacaccacccaggcaggtaggaaccacctagtccactatcgccagttgctcctagcgggtctccaaaacgcgggcagaagccccaccaatttggccaaggtaaaaggaataacacaagggcccaatgagtctccctcggccttcctagagagacttaaggaagcctatcgcaggtacactccttatgaccctgaggacccagggcaagaaactaatgtgtctatgtctttcatttggcagtctgccccagacattgggagaaagttagagaggttagaagatttaaaaaacaagacgcttggagatttggttagagaggcagaaaagatctttaataaacgagaaaccccggaagaaagagaggaacgtatcaggagagaaacagaggaaaaagaagaacgccgtaggacagaggatgagcagaaagagaaagaaagagatcgtaggagacatagagagatgagcaagctattggccactgtcgttagtggacagaaacaggatagacagggaggagaacgaaggaggtcccaactcgatcgcgaccagtgtgcctactgcaaagaaaaggggcactgggctaaagattgtcccaagaaaccacgaggacctcggggaccaagaccccagacctccctcctgaccctagatgactagggaggtcagggtcaggagcccccccctgaacccaggataaccctcaaagtcggggggcaacccgtcaccttcctggtagatactggggcccaacactccgtgctgacccaaaatcctggacccctaagtgataagtctgcctgggtccaaggggctactggaggaaagcggtatcgctggaccacggatcgcaaagtacatctagctaccggtaaggtcacccactctttcctccatgtaccagactgtccctatcctctgttaggaagagatttgctgactaaactaaaagcccaaatccactttgagggatcaggagctcaggttatgggaccaatggggcagcccctgcaagtgttgaccctaaatatagaagatgagcatcggctacatgagacctcaaaagagccagatgtttctctagggtccacatggctgtctgattttcctcaggcctgggcggaaaccgggggcatgggactggcagttcgccaagctcctctgatcatacctctgaaagcaacctctacccccgtgtccataaaacaataccccatgtcacaagaagccagactggggatcaagccccacatacagagactgttggaccagggaatactggtaccctgccagtccccctggaacacgcccctgctacccgttaagaaaccagggactaatgattataggcctgtccaggatctgagagaagtcaacaagcgggtggaagacatccaccccaccgtgcccaacccttacaacctcttgagcgggctcccaccgtcccaccagtggtacactgtgcttgagttaaaggatgcctttttctgcctgagactccaccccaccagtcagcctctcttcgcctttgagtggagagatccagagatgggaatctcaggacaattgacctggaccagactcccacagggtttcaaaaacagtcccaccctgtttgatgaggcactgcacagagacctagcagacttccggatccagcacccagacttgatcctgctacagtacgtggatgacttactgctggccgccacttctgagctagactgccaacaaggtactcgggccctgttacaaaccctagggaacctcgggtatcgggcctcggccaagaaagcccaaatttgccagaaacaggtcaagtatctggggtatcttctaaaagagggtcagagatggctgactgaggccagaaaagagactgtgatggggcagcctactccgaagacccctcgacaactaagggagttcctagggacggcaggcttctgtcgcctctggatccctgggtttgcagaaatggcagcccccttgtaccctctcaccaaaacggggactctgtttaattggggcccagaccaacaaaaggcctatcaagaaatcaagcaagctcttctaactgccccagccctggggttgccagatttgactaagccctttgaactctttgtcgacgagaagcagggctacgccaaaggcgtcctaacgcaaaagctgggaccttggcgtcggccggtggcctacctgtctaaaaagctagacccagtggcagctggctggcccccctgcctacggatggtggcagccattgcagttctgacaaaagatgctggcaagctcactatgggacagccgttggtcattctggccccccatgccgtagaggcactagttaagcaaccccctgatcgctggctctccaatgcccggatgacccattaccaagccctgctcctggacacggaccgggtccagttcgggccagtagtggccctaaatccagctacgctgctccctctgcctgaggaggggctgcaacatgactgccttgacatcttggctgaagcccacggaactagatcagatcttacggaccagcccctcccagacgccgaccacacctggtacacggatgggagcagcttcctgcaagaagggcagcgtaaggccggagcagcggtgaccactgagactgaggtaatctgggccagggcattgccagccgggacatcggcccaaagagctgaactgatagcgctcacccaagccctaaagatggcagaaggtaagaagctaaatgtttatactgatagccgttacgcttttgccaccgcccatattcatggagaaatatacagaaggcgcgggttgctcacatcagaaggaaaagagatcaagaacaaggacgagatcttagccctactaaaggctctcttcttgcccaaaagacttagcataattcattgcccgggacatcaaaaaggaaacagcgcagaggccaggggcaaccggatggccgaccaagcggcccgagaagtagccactagagaaactccaggaacttccacacttctgatagaaaactcaaccccctatacccatgaacactttcactatacagtaactgacacaaaggatttgaccaaactaggagccacttatgacagtgcgaagaaatattgggtctatcaaggaaagcctgttatgcctgatcaattcacctttgagttactagactttcttcaccaattgacccacctcagcttctcaaaaacaaaggctctcctagagagaagccccagtccctactacatgctgaaccgggatcgaacactcaaaaatatcactgagacctgcaaagcttgtgcacaagtcaatgccagcaagtctgccgttaagcaaggaactagggtccgcgggcatcggcctggcacacactgggagatcgatttcaccgaggtaaaacctggattgtatggctataagtatcttttagtttttgtagatactttttctggctggatagaagctttcccaactaagaaagaaaccgccaaggtcgtgaccaagaaactgctagaagagatcttccctaggttcggcatgccgcaggtattgggaactgacaatgggcctgccttcgtctccaaggtgagtcagacagtggccgatctgttggggattgattggaaattacattgtgcatacagaccccaaagctcaggtcaggtagaaagaatgaataggaccatcaaggagactttaactaaattaacgcttgcaactggctctagagactgggtgctcctactccccttagccctgtaccgagcccgcaacacgccgggcccccatggcctcaccccatatgagatcttatatggggcacccccgccccttgtaaacttccctgaccctgacatgaccagagttactaacagcccctctctccaagctcacttacaggctctctacttagtccagcacgaagtttggagaccactggcggcagcttaccaagaacaactggaccggccggtggtgcctcacccttaccgggtcggcgacacagtgtgggtccgccgacatcaaaccaagaacctagaacctcgctggaaaggaccttacacagtcctgctgaccacccccaccgccctcaaagtagacggtatcgcagcttggatacacgcagcccacgtaaaggcggccgacaccgagagtggaccatcctctggacggacatggcgcgttcaacgctctcaaaaccccctcaagataagattaacccgtggaagcccttaaaagctcgaggccgccccggtgaccttcagaccttggcactggaggtggcccggcagaagcgcggcatcgtggatcagtgctgcaccagcatctgctctctctaccaactggagaactactgcaactaggcccaccactaccctgtccacccctctgcaatgaataaaacctttgaaagagcactacaagttgtgtgtacatgcgtgcatgtgcatatgtggtgcggggggaacatgagtggggctggctggagtggcgatgataagctgtcaaacatgagaattaattcttgaagacgaaagggcctcgtgatacgcctatttttataggttaatgtcatgataataatggtttcttagtctagaattaattccgtgtattctatagtgtcacctaaatcgtatgtgtatgatacataaggttatgtattaattgtagccgcgttctaacgacaatatgtacaagcctaattgtgtagcatctggcttactgaagcagaccctatcatctctctcgtaaactgccgtcagagtcggtttggttggacgaaccttctgagtttctggtaacgccgtcccgcacccggaaatggtcagcgaaccaatcagcagggtcatcgctagccagatcctctacgccggacgcatcgtggccggcatcaccggcgccacaggtgcggttgctggcgcctatatcgccgacatcaccgatggggaagatcgggctcgccacttcgggctcatgagcgcttgtttcggcgtgggtatggtggcaggccccgtggccgggggactgttgggcgccatctccttgcatgcaccattccttgcggcggcggtgctcaacggcctcaacctactactgggctgcttcctaatgcaggagtcgcataagggagagcgtcgaatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcacatgagcgaaaaatacatcgtcacctgggacatgttgcagatccatgcacgtaaactcgcaagccgactgatgccttctgaacaatggaaaggcattattgccgtaagccgtggcggtctgtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaatcttttcaacgcctggcactgccgggcgttgttctttttaacttcaggcgggttacaatagtttccagtaagtattctggaggctgcatccatgacacaggcaaacctgagcgaaaccctgttcaaaccccgctttaaacatcctgaaacctcgacgctagtccgccgctttaatcacggcgcacaaccgcctgtgcagtcggcccttgatggtaaaaccatccctcactggtatcgcatgattaaccgtctgatgtggatctggcgcggcattgacccacgcgaaatcctcgacgtccaggcacgtattgtgatgagcgatgccgaacgtaccgacgatgatttatacgatacggtgattggctaccgtggcggcaactggatttatgagtgggccccggatctttgtgaaggaaccttacttctgtggtgtgacataattggacaaactacctacagagatttaaagctctaaggtaaatataaaatttttaacccggatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccaaaaaagaagagaaaggtagaagaccccaaggactttccttcagaattgctaagttttttgagtcatgctgtgtttagtaatagaactcttgcttgctttgctatttacaccacaaaggaaaaagctgcactgctatacaagaaaattatggaaaaatattctgtaacctttataagtaggcataacagttataatcataacatactgttttttcttactccacacaggcatagagtgtctgctattaataactatgctcaaaaattgtgtacctttagctttttaatttgtaaaggggttaataaggaatatttgatgtatagtgccttgactagagatcataatcagccataccacatttgtagaggttttacttgctttaaaaaacctcccacacctccccctgaacctgaaacataaaatgaatgcaattgttgttgttgggctgcaggaattaattcgagctcgcccgaca

SEQ ID NO: 59 - DNA, 7564 bp, Artificial sequence
  SEQ ID NO: 59
tttgaaagaccccacccgtaggtggcaagctagcttaagtaacgccactttgcaaggcatggaaaaatacataactgagaatagaaaagttcagatcaaggtcaggaacaaagaaacagctgaataccaaacaggatatctgtggtaagcggttcctgccccggctcagggccaagaacagatgagacagctgagtgatgggccaaacaggatatctgtggtaagcagttcctgccccggctcggggccaagaacagatggtccccagatgcggtccagccctcagcagtttctagtgaatcatcagatgtttccagggtgccccaaggacctgaaaatgaccctgtaccttatttgaactaaccaatcagttcgcttctcgcttctgttcgcgcgcttccgctctccgagctcaataaaagagcccacaacccctcactcggcgcgccagtcttccgatagactgcgtcgcccgggtacccgtattcccaataaagcctcttgctgtttgcatccgaatcgtggtctcgctgttccttgggagggtctcctctgagtgattgactacccacgacgggggtctttcatttgggggctcgtccgggatttggagacccctgcccagggaccaccgacccaccaccgggaggtaagctggccagcaacttatctgtgtctgtccgattgtctagtgtctatgtttgatgttatgcgcctgcgtctgtactagttagctaactagctctgtatctggcggacccgtggtggaactgacgagttctgaacacccggccgcaaccctgggagacgtcccagggactttgggggccgtttttgtggcccgacctgaggaagggagtcgatgtggaatccgaccccgtcaggatatgtggttctggtaggagacgagaacctaaaacagttcccgcctccgtctgaatttttgctttcggtttggaaccgaagccgcgcgtcttgtctgctgcagcgctgcagcatcgttctgtgttgtctctgtctgactgtgtttctgtatttgtctgaaaattagggccagactgttaccactcccttaagtttgaccttaggtcactggaaagatgtcgagcggatcgctcacaaccagtcggtagatgtcaagaagagacgttgggttaccttctgctctgcagaatggccaacctttaacgtcggatggccgcgagacggcacctttaaccgagacctcatcacccaggttaagatcaaggtcttttcacctggcccgcatggacacccagaccaggtcccctacatcgtgacctgggaagccttggcttttgacccccctccctgggtcaagccctttgtacaccctaagcctccgcctcctcttcctccatccgccccgtctctcccccttgaacctcctcgttcgaccccgcctcgatcctccctttatccagccctcactccttctctaggcgccggaattcgtttaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatccgctagcgctaccggactcagatctcgagatcagcttggcattccggtactgttggtaaagccaccatggaagacgccaaaaacataaagaaaggcccggcgccattctatccgctggaagatggaaccgctggagagcaactgcataaggctatgaagagatacgccctggttcctggaacaattgcttttacagatgcacatatcgaggtggacatcacttacgctgagtacttcgaaatgtccgttcggttggcagaagctatgaaacgatatgggctgaatacaaatcacagaatcgtcgtatgcagtgaaaactctcttcaattctttatgccggtgttgggcgcgttatttatcggagttgcagttgcgcccgcgaacgacatttataatgaacgtgaattgctcaacagtatgggcatttcgcagcctaccgtggtgttcgtttccaaaaaggggttgcaaaaaattttgaacgtgcaaaaaaagctcccaatcatccaaaaaattattatcatggattctaaaacggattaccagggatttcagtcgatgtacacgttcgtcacatctcatctacctcccggttttaatgaatacgattttgtgccagagtccttcgatagggacaagacaattgcactgatcatgaactcctctggatctactggtctgcctaaaggtgtcgctctgcctcatagaactgcctgcgtgagattctcgcatgccagagatcctatttttggcaatcaaatcattccggatactgcgattttaagtgttgttccattccatcacggttttggaatgtttactacactcggatatttgatatgtggatttcgagtcgtcttaatgtatagatttgaagaagagctgtttctgaggagccttcaggattacaagattcaaagtgcgctgctggtgccaaccctattctccttcttcgccaaaagcactctgattgacaaatacgatttatctaatttacacgaaattgcttctggtggcgctcccctctctaaggaagtcggggaagcggttgccaagaggttccatctgccaggtatcaggcaaggatatgggctcactgagactacatcagctattctgattacacccgagggggatgataaaccgggcgcggtcggtaaagttgttccattttttgaagcgaaggttgtggatctggataccgggaaaacgctgggcgttaatcaaagaggcgaactgtgtgtgagaggtcctatgattatgtccggttatgtaaacaatccggaagcgaccaacgccttgattgacaaggatggatggctacattctggagacatagcttactgggacgaagacgaacacttcttcatcgttgaccgcctgaagtctctgattaagtacaaaggctatcaggtggctcccgctgaattggaatccatcttgctccaacaccccaacatcttcgacgcaggtgtcgcaggtcttcccgacgatgacgccggtgaacttcccgccgccgttgttgttttggagcacggaaagacgatgacggaaaaagagatcgtggattacgtcgccagtcaagtaacaaccgcgaaaaagttgcgcggaggagttgtgtttgtggacgaagtaccgaaaggtcttaccggaaaactcgacgcaagaaaaatcagagagatcctcataaaggccaagaagggcggaaagatcgccgtgtaattctagtagtggccaggatccgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcatcgggaataaaagattttatttagtctccagaaaaaggggggaatgaaagaccccacctgtaggtttggcaagctagcttaagtaacgccattttgcaaggcatggaaaaatacataactgagaatagagaagttcagatcaaggtcaggaacagatggaacagctgaatatgggccaaacaggatatctgtggtaagcagttcctgccccggctcagggccaagaacagatggaacagctgaatatgggccaaacaggatatctgtggtaagcagttcctgccccggctcagggccaagaacagatggtccccagatgcggtccagccctcagcagtttctagagaaccatcagatgtttccagggtgccccaaggacctgaaatgaccctgtgccttatttgaactaaccaatcagttcgcttctcgcttctgttcgcgcgcttctgctccccgagctcaataaaagagcccacaacccctcactcggggcgccagtcctccgattgactgagtcgcccgggtacccgtgtatccaataaaccctcttgcagttgcatccgacttgtggtctcgctgttccttgggagggtctcctctgagtgattgactacccgtcagcgggggtctttcatttgggggctcgtccgggatcgggagacccctgcccagggaccaccgacccaccaccgggaggtaagctggctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaagaattgctagcaattgctagcaattgctagcaattcataccagatcaccgaaaactgtcctccaaatgtgtccccctcacactcccaaattcgcgggcttctgcctcttagaccactctaccctattccccacactcaccggagccaaagccgcggcccttccgtttctttgct

SEQ ID NO: 60 - DNA, 11462 bp, Artificial sequence
  SEQ ID NO: 60
ttgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagagtctataggcccacccccttggcttcttatgcgacggatcgatcccgtaataagcttcgaggtccgcggccggccgcgttgacgcgcacggcaagaggcgaggggcggcgactggtgagagatgggccagactgttaccactcccttaagtttgaccttaggtcactggaaagatgtcgagcggatcgctcacaaccagtcggtagatgtcaagaagagacgttgggttaccttctgctctgcagaatggccaacctttaacgtcggatggccgcgagacggcacctttaaccgagacctcatcacccaggttaagatcaaggtcttttcacctggcccgcatggacacccagaccaggtcccctacatcgtgacctgggaagccttggcttttgacccccctccctgggtcaagccctttgtacaccctaagcctccgcctcctcttcctccatccgccccgtctctcccccttgaacctcctcgttcgaccccgcctcgatcctccctttatccagccctcactccttctctaggcgccaaacctaaacctcaagttctttctgacagtggggggccgctcatcgacctacttacagaagaccccccgccttatagggacccaagaccacccccttccgacagggacggaaatggtggagaagcgacccctgcgggagaggcaccggacccctccccaatggcatctcgcctacgtgggagacgggagccccctgtggccgactccactacctcgcaggcattccccctccgcgcaggaggaaacggacagcttcaatactggccgttctcctcttctgacctttacaactggaaaaataataacccttctttttctgaagatccaggtaaactgacagctctgatcgagtctgttctcatcacccatcagcccacctgggacgactgtcagcagctgttggggactctgctgaccggagaagaaaaacaacgggtgctcttagaggctagaaaggcggtgcggggcgatgatgggcgccccactcaactgcccaatgaagtcgatgccgcttttcccctcgagcgcccagactgggattacaccacccaggcaggtaggaaccacctagtccactatcgccagttgctcctagcgggtctccaaaacgcgggcagaagccccaccaatttggccaaggtaaaaggaataacacaagggcccaatgagtctccctcggccttcctagagagacttaaggaagcctatcgcaggtacactccttatgaccctgaggacccagggcaagaaactaatgtgtctatgtctttcatttggcagtctgccccagacattgggagaaagttagagaggttagaagatttaaaaaacaagacgcttggagatttggttagagaggcagaaaagatctttaataaacgagaaaccccggaagaaagagaggaacgtatcaggagagaaacagaggaaaaagaagaacgccgtaggacagaggatgagcagaaagagaaagaaagagatcgtaggagacatagagagatgagcaagctattggccactgtcgttagtggacagaaacaggatagacagggaggagaacgaaggaggtcccaactcgatcgcgaccagtgtgcctactgcaaagaaaaggggcactgggctaaagattgtcccaagaaaccacgaggacctcggggaccaagaccccagacctccctcctgaccctagatgactagggaggtcagggtcaggagcccccccctgaacccaggataaccctcaaagtcggggggcaacccgtcaccttcctggtagatactggggcccaacactccgtgctgacccaaaatcctggacccctaagtgataagtctgcctgggtccaaggggctactggaggaaagcggtatcgctggaccacggatcgcaaagtacatctagctaccggtaaggtcacccactctttcctccatgtaccagactgtccctatcctctgttaggaagagatttgctgactaaactaaaagcccaaatccactttgagggatcaggagctcaggttatgggaccaatggggcagcccctgcaagtgttgaccctaaatatagaagatgagcatcggctacatgagacctcaaaagagccagatgtttctctagggtccacatggctgtctgattttcctcaggcctgggcggaaaccgggggcatgggactggcagttcgccaagctcctctgatcatacctctgaaagcaacctctacccccgtgtccataaaacaataccccatgtcacaagaagccagactggggatcaagccccacatacagagactgttggaccagggaatactggtaccctgccagtccccctggaacacgcccctgctacccgttaagaaaccagggactaatgattataggcctgtccaggatctgagagaagtcaacaagcgggtggaagacatccaccccaccgtgcccaacccttacaacctcttgagcgggctcccaccgtcccaccagtggtacactgtgcttgatttaaaggatgcctttttctgcctgagactccaccccaccagtcagcctctcttcgcctttgagtggagagatccagagatgggaatctcaggacaattgacctggaccagactcccacagggtttcaaaaacagtcccaccctgtttgatgaggcactgcacagagacctagcagacttccggatccagcacccagacttgatcctgctacagtacgtggatgacttactgctggccgccacttctgagctagactgccaacaaggtactcgggccctgttacaaaccctagggaacctcgggtatcgggcctcggccaagaaagcccaaatttgccagaaacaggtcaagtatctggggtatcttctaaaagagggtcagagatggctgactgaggccagaaaagagactgtgatggggcagcctactccgaagacccctcgacaactaagggagttcctagggacggcaggcttctgtcgcctctggatccctgggtttgcagaaatggcagcccccttgtaccctctcaccaaaacggggactctgtttaattggggcccagaccaacaaaaggcctatcaagaaatcaagcaagctcttctaactgccccagccctggggttgccagatttgactaagccctttgaactctttgtcgacgagaagcagggctacgccaaaggcgtcctaacgcaaaagctgggaccttggcgtcggccggtggcctacctgtctaaaaagctagacccagtggcagctggctggcccccctgcctacggatggtggcagccattgcagttctgacaaaagatgctggcaagctcactatgggacagccgttggtcattctggccccccatgccgtagaggcactagttaagcaaccccctgatcgctggctctccaatgcccggatgacccattaccaagccctgctcctggacacggaccgggtccagttcgggccagtagtggccctaaatccagctacgctgctccctctgcctgaggaggggctgcaacatgactgccttgacatcttggctgaagcccacggaactagatcagatcttacggaccagcccctcccagacgccgaccacacctggtacacggatgggagcagcttcctgcaagaagggcagcgtaaggccggagcagcggtgaccactgagactgaggtaatctgggccagggcattgccagccgggacatcggcccaaagagctcaactgatagcgctcacccaagccctaaagatggcagaaggtaagaagctaaatgtttatactgatagccgttacgcttttgccaccgcccatattcatggagaaatatacagaaggcgcgggttgctcacatcagaaggaaaagagatcaagaacaaggacgagatcttagccctactaaaggctctcttcttgcccaaaagacttagcataattcattgcccgggacatcaaaaaggaaacagcgcagaggccaggggcaaccggatggccgaccaagcggcccgagaagtagccactagagaaactccaggaacttccacacttctgatagaaaactcaaccccctatacccatgaacactttcactatacagtaactgacacaaaggatttgaccaaactaggagccacttatgacagtgcgaagaaatattgggtctatcaaggaaagcctgttatgcctgatcaattcacctttgagttactagactttcttcaccaattgacccacctcagcttctcaaaaacaaaggctctcctagagagaagccccagtccctactacatgctgaaccgggatcgaacactcaaaaatatcactgagacctgcaaagcttgtgcacaagtcaatgccagcaagtctgccgttaagcaaggaactagggtccgcgggcatcggcctggcacacactgggagatcgatttcaccgaggtaaaacctggattgtatggctataagtatcttttagtttttgtagatactttttctggctggatagaagctttcccaactaagaaagaaaccgccaaggtcgtgaccaagaaactgctagaagagatcttccctaggttcggcatgccgcaggtattgggaactgacaatgggcctgccttcgtctccaaggtgagtcagacagtggccgatctgttggggattgattggaaattacattgtgcatacagaccccaaagctcaggtcaggtagaaagaatgaataggaccatcaaggagactttaactaaattaacgcttgcaactggctctagagactgggtgctcctactccccttagccctgtaccgagcccgcaacacgccgggcccccatggcctcaccccatatgagatcttatatggggcacccccgccccttgtaaacttccctgaccctgacatgaccagagttactaacagcccctctctccaagctcacttacaggctctctacttagtccagcacgaagtttggagaccactggcggcagcttaccaagaacaactggaccggccggtggtgcctcacccttaccgggtcggcgacacagtgtgggtccgccgacatcaaaccaagaacctagaacctcgctggaaaggaccttacacagtcctgctgaccacccccaccgccctcaaagtagacggtatcgcagcttggatacacgcagcccacgtaaaggcggccgacaccgagagtggaccatcctctggacggacatggcgcgttcaacgctctcaaaaccccctcaagataagattaacccgtggaagcccttaaaagctcgaggccgccccggtgaccttcagaccttggcactggaggtggcccggcagaagcgcggcatcgtggatcagtgctgcaccagcatctgctctctctaccaactggagaactactgcaactaggcccaccactaccctgtccacccctctgcaatgaataaaacctttgaaagagcactacaagttgtgtgtacatgcgtgcatgtgcatatgtggtgcggggggaacatgagtggggctggctggagtggcgatgataagctgtcaaacatgagaattaattcttgaagacgaaagggcctcgtgatacgcctatttttataggttaatgtcatgataataatggtttcttagtctagaattaattccgtgtattctatagtgtcacctaaatcgtatgtgtatgatacataaggttatgtattaattgtagccgcgttctaacgacaatatgtacaagcctaattgtgtagcatctggcttactgaagcagaccctatcatctctctcgtaaactgccgtcagagtcggtttggttggacgaaccttctgagtttctggtaacgccgtcccgcacccggaaatggtcagcgaaccaatcagcagggtcatcgctagccagatcctctacgccggacgcatcgtggccggcatcaccggcgccacaggtgcggttgctggcgcctatatcgccgacatcaccgatggggaagatcgggctcgccacttcgggctcatgagcgcttgtttcggcgtgggtatggtggcaggccccgtggccgggggactgttgggcgccatctccttgcatgcaccattccttgcggcggcggtgctcaacggcctcaacctactactgggctgcttcctaatgcaggagtcgcataagggagagcgtcgaatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcacatgagcgaaaaatacatcgtcacctgggacatgttgcagatccatgcacgtaaactcgcaagccgactgatgccttctgaacaatggaaaggcattattgccgtaagccgtggcggtctgtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaatcttttcaacgcctggcactgccgggcgttgttctttttaacttcaggcgggttacaatagtttccagtaagtattctggaggctgcatccatgacacaggcaaacctgagcgaaaccctgttcaaaccccgctttaaacatcctgaaacctcgacgctagtccgccgctttaatcacggcgcacaaccgcctgtgcagtcggcccttgatggtaaaaccatccctcactggtatcgcatgattaaccgtctgatgtggatctggcgcggcattgacccacgcgaaatcctcgacgtccaggcacgtattgtgatgagcgatgccgaacgtaccgacgatgatttatacgatacggtgattggctaccgtggcggcaactggatttatgagtgggccccggatctttgtgaaggaaccttacttctgtggtgtgacataattggacaaactacctacagagatttaaagctctaaggtaaatataaaatttttaacccggatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccaaaaaagaagagaaaggtagaagaccccaaggactttccttcagaattgctaagttttttgagtcatgctgtgtttagtaatagaactcttgcttgctttgctatttacaccacaaaggaaaaagctgcactgctatacaagaaaattatggaaaaatattctgtaacctttataagtaggcataacagttataatcataacatactgttttttcttactccacacaggcatagagtgtctgctattaataactatgctcaaaaattgtgtacctttagctttttaatttgtaaaggggttaataaggaatatttgatgtatagtgccttgactagagatcataatcagccataccacatttgtagaggttttacttgctttaaaaaacctcccacacctccccctgaacctgaaacataaaatgaatgcaattgttgttgttgggctgcaggaattaattcgagctcgcccgaca

SEQ ID NO: 61 - DNA, 11277 bp, Artificial sequence
  SEQ ID NO: 61
ttgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagagtctataggcccacccccttggcttcttatgcgacggatcgatcccgtaataagcttcgaggtccgcggccggccgcgttgacgcgcacggcaagaggcgaggggcggcgactggtgagagatgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaataaagataggggggcaattaaaggaagctctattagatacaggagcagatgatacagtattagaagaaatgaatttgccaggaagatggaaaccaaaaatgatagggggaattggaggttttatcaaagtaagacagtatgatcagatactcatagaaatctgcggacataaagctataggtacagtattagtaggacctacacctgtcaacataattggaagaaatctgttgactcagattggctgcactttaaattttcccattagtcctattgagactgtaccagtaaaattaaagccaggaatggatggcccaaaagttaaacaatggccattgacagaagaaaaaataaaagcattagtagaaatttgtacagaaatggaaaaggaaggaaaaatttcaaaaattgggcctgaaaatccatacaatactccagtatttgccataaagaaaaaagacagtactaaatggagaaaattagtagatttcagagaacttaataagagaactcaagatttctgggaagttcaattaggaataccacatcctgcaaaattacccatacaaaaggaaacatgggaagcatggtggacagagtattggcaagccacctggattcctgagtgggagtttgtcaatacccctcccttagtgaagttatggtaccagttagagaaagaacccataataggagcagaaactttctatgtagatggggcagccaatagggaaactaaattaggaaaagcaggatatgtaactgacagaggaagacaaaaagttgtccccctaacggacacaacaaatcagaagactgagttacaagcaattcatctagctttgcaggattcgggattagaagtaaacatagtgacagactcacaatatgcattgggaatcattcaagcacaaccagataagagtgaatcagagttagtcagtcaaataatagagcagttaataaaaaaggaaaaagtctacctggcatgggtaccagcacacaaaggaattggaggaaatgaacaagtagataaattggtcagtgctggaatcaggaaagtactatttttagatggaatagataaggcccaagaagaacatgagaaatatcacagtaattggagagcaatggctagtgattttaacctaccacctgtagtagcaaaagaaatagtagccagctgtgataaatgtcagctaaaaggggaagccatgcatggacaagtagactgtagcccaggaatatggcagctagattgtacacatttagaaggaaaagttatcttggtagcagttcatgtagccagtggatatatagaagcagaagtaattccagcagagacagggcaagaaacagcatacttcctcttaaaattagcaggaagatggccagtaaaaacagtacatacagacaatggcagcaatttcaccagtactacagttaaggccgcctgttggtgggcggggatcaagcaggaatttggcattccctacaatccccaaagtcaaggagtaatagaatctatgaataaagaattaaagaaaattataggacaggtaagagatcaggctgaacatcttaagacagcagtacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggaaaggaccagcaaagctcctctggaaaggtgaaggggcagtagtaatacaagataatagtgacataaaagtagtgccaagaagaaaagcaaagatcatcagggattatggaaaacagatggcaggtgatgattgtgtggcaagtagacaggatgaggattaacacatggaattctgcaacaactgctgtttatccatttcagaattgggtgtcgacatagcagaataggcgttactcgacagaggagagcaagaaatggagccagtagatcctagactagagccctggaagcatccaggaagtcagcctaaaactgcttgtaccaattgctattgtaaaaagtgttgctttcattgccaagtttgtttcatgacaaaagccttaggcatctcctatggcaggaagaagcggagacagcgacgaagagctcatcagaacagtcagactcatcaagcttctctatcaaagcagtaagtagtacatgtaatgcaacctataatagtagcaatagtagcattagtagtagcaataataatagcaatagttgtgtggtccatagtaatcatagaatataggaaaatggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatccttggcacttatctgggacgatctgcggagcctgtgcctcttcagctaccaccgcttgagagacttactcttgattgtaacgaggattgtggaacttctgggacgcagggggtgggaagccctcaaatattggtggaatctcctacaatattggagtcaggagctaaagaatagtgctgttagcttgctcaatgccacagccatagcagtagctgaggggacagatagggttatagaagtagtacaaggagcttgtagagctattcgccacatacctagaagaataagacagggcttggaaaggattttgctataagctcgaggccgccccggtgaccttcagaccttggcactggaggtggcccggcagaagcgcggcatcgtggatcagtgctgcaccagcatctgctctctctaccaactggagaactactgcaactaggcccaccactaccctgtccacccctctgcaatgaataaaacctttgaaagagcactacaagttgtgtgtacatgcgtgcatgtgcatatgtggtgcggggggaacatgagtggggctggctggagtggcgatgataagctgtcaaacatgagaattaattcttgaagacgaaagggcctcgtgatacgcctatttttataggttaatgtcatgataataatggtttcttagtctagaattaattccgtgtattctatagtgtcacctaaatcgtatgtgtatgatacataaggttatgtattaattgtagccgcgttctaacgacaatatgtacaagcctaattgtgtagcatctggcttactgaagcagaccctatcatctctctcgtaaactgccgtcagagtcggtttggttggacgaaccttctgagtttctggtaacgccgtcccgcacccggaaatggtcagcgaaccaatcagcagggtcatcgctagccagatcctctacgccggacgcatcgtggccggcatcaccggcgccacaggtgcggttgctggcgcctatatcgccgacatcaccgatggggaagatcgggctcgccacttcgggctcatgagcgcttgtttcggcgtgggtatggtggcaggccccgtggccgggggactgttgggcgccatctccttgcatgcaccattccttgcggcggcggtgctcaacggcctcaacctactactgggctgcttcctaatgcaggagtcgcataagggagagcgtcgaatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcacatgagcgaaaaatacatcgtcacctgggacatgttgcagatccatgcacgtaaactcgcaagccgactgatgccttctgaacaatggaaaggcattattgccgtaagccgtggcggtctgtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaatcttttcaacgcctggcactgccgggcgttgttctttttaacttcaggcgggttacaatagtttccagtaagtattctggaggctgcatccatgacacaggcaaacctgagcgaaaccctgttcaaaccccgctttaaacatcctgaaacctcgacgctagtccgccgctttaatcacggcgcacaaccgcctgtgcagtcggcccttgatggtaaaaccatccctcactggtatcgcatgattaaccgtctgatgtggatctggcgcggcattgacccacgcgaaatcctcgacgtccaggcacgtattgtgatgagcgatgccgaacgtaccgacgatgatttatacgatacggtgattggctaccgtggcggcaactggatttatgagtgggccccggatctttgtgaaggaaccttacttctgtggtgtgacataattggacaaactacctacagagatttaaagctctaaggtaaatataaaatttttaacccggatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccaaaaaagaagagaaaggtagaagaccccaaggactttccttcagaattgctaagttttttgagtcatgctgtgtttagtaatagaactcttgcttgctttgctatttacaccacaaaggaaaaagctgcactgctatacaagaaaattatggaaaaatattctgtaacctttataagtaggcataacagttataatcataacatactgttttttcttactccacacaggcatagagtgtctgctattaataactatgctcaaaaattgtgtacctttagctttttaatttgtaaaggggttaataaggaatatttgatgtatagtgccttgactagagatcataatcagccataccacatttgtagaggttttacttgctttaaaaaacctcccacacctccccctgaacctgaaacataaaatgaatgcaattgttgttgttgggctgcaggaattaattcgagctcgcccgaca

SEQ ID NO: 62 - DNA, 9434 bp, Artificial sequence
  SEQ ID NO: 62
ttgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagagtctataggcccacccccttggcttcttatgcgacggatcgatcccgtaataagcttcgaggtccgcggccggccgcgttgacgcgcacggcaagaggcgaggggcggcgactggtgagagatgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaataaagataggggggcaattaaaggaagctctattagatacaggagcagatgatacagtattagaagaaatgaatttgccaggaagatggaaaccaaaaatgatagggggaattggaggttttatcaaagtaagacagtattcgacatagcagaataggcgttactcgacagaggagagcaagaaatggagccagtagatcctagactagagccctggaagcatccaggaagtcagcctaaaactgcttgtaccaattgctattgtaaaaagtgttgctttcattgccaagtttgtttcatgacaaaagccttaggcatctcctatggcaggaagaagcggagacagcgacgaagagctcatcagaacagtcagactcatcaagcttctctatcaaagcagtaagtagtacatgtaatgcaacctataatagtagcaatagtagcattagtagtagcaataataatagcaatagttgtgtggtccatagtaatcatagaatataggaaaatggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatccttggcacttatctgggacgatctgcggagcctgtgcctcttcagctaccaccgcttgagagacttactcttgattgtaacgaggattgtggaacttctgggacgcagggggtgggaagccctcaaatattggtggaatctcctacaatattggagtcaggagctaaagaatagtgctgttagcttgctcaatgccacagccatagcagtagctgaggggacagatagggttatagaagtagtacaaggagcttgtagagctattcgccacatacctagaagaataagacagggcttggaaaggattttgctataagctcgaggccgccccggtgaccttcagaccttggcactggaggtggcccggcagaagcgcggcatcgtggatcagtgctgcaccagcatctgctctctctaccaactggagaactactgcaactaggcccaccactaccctgtccacccctctgcaatgaataaaacctttgaaagagcactacaagttgtgtgtacatgcgtgcatgtgcatatgtggtgcggggggaacatgagtggggctggctggagtggcgatgataagctgtcaaacatgagaattaattcttgaagacgaaagggcctcgtgatacgcctatttttataggttaatgtcatgataataatggtttcttagtctagaattaattccgtgtattctatagtgtcacctaaatcgtatgtgtatgatacataaggttatgtattaattgtagccgcgttctaacgacaatatgtacaagcctaattgtgtagcatctggcttactgaagcagaccctatcatctctctcgtaaactgccgtcagagtcggtttggttggacgaaccttctgagtttctggtaacgccgtcccgcacccggaaatggtcagcgaaccaatcagcagggtcatcgctagccagatcctctacgccggacgcatcgtggccggcatcaccggcgccacaggtgcggttgctggcgcctatatcgccgacatcaccgatggggaagatcgggctcgccacttcgggctcatgagcgcttgtttcggcgtgggtatggtggcaggccccgtggccgggggactgttgggcgccatctccttgcatgcaccattccttgcggcggcggtgctcaacggcctcaacctactactgggctgcttcctaatgcaggagtcgcataagggagagcgtcgaatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcacatgagcgaaaaatacatcgtcacctgggacatgttgcagatccatgcacgtaaactcgcaagccgactgatgccttctgaacaatggaaaggcattattgccgtaagccgtggcggtctgtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaatcttttcaacgcctggcactgccgggcgttgttctttttaacttcaggcgggttacaatagtttccagtaagtattctggaggctgcatccatgacacaggcaaacctgagcgaaaccctgttcaaaccccgctttaaacatcctgaaacctcgacgctagtccgccgctttaatcacggcgcacaaccgcctgtgcagtcggcccttgatggtaaaaccatccctcactggtatcgcatgattaaccgtctgatgtggatctggcgcggcattgacccacgcgaaatcctcgacgtccaggcacgtattgtgatgagcgatgccgaacgtaccgacgatgatttatacgatacggtgattggctaccgtggcggcaactggatttatgagtgggccccggatctttgtgaaggaaccttacttctgtggtgtgacataattggacaaactacctacagagatttaaagctctaaggtaaatataaaatttttaacccggatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccaaaaaagaagagaaaggtagaagaccccaaggactttccttcagaattgctaagttttttgagtcatgctgtgtttagtaatagaactcttgcttgctttgctatttacaccacaaaggaaaaagctgcactgctatacaagaaaattatggaaaaatattctgtaacctttataagtaggcataacagttataatcataacatactgttttttcttactccacacaggcatagagtgtctgctattaataactatgctcaaaaattgtgtacctttagctttttaatttgtaaaggggttaataaggaatatttgatgtatagtgccttgactagagatcataatcagccataccacatttgtagaggttttacttgctttaaaaaacctcccacacctccccctgaacctgaaacataaaatgaatgcaattgttgttgttgggctgcaggaattaattcgagctcgcccgaca

SEQ ID NO: 63 - DNA, 9819 bp, Artificial sequence
  SEQ ID NO: 63
ttgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagagtctataggcccacccccttggcttcttatgcgacggatcgatcccgtaataagcttcgaggtccgcggccggccgcgttgacgcgcacggcaagaggcgaggggcggcgactggtgagagatgggccagactgttaccactcccttaagtttgaccttaggtcactggaaagatgtcgagcggatcgctcacaaccagtcggtagatgtcaagaagagacgttgggttaccttctgctctgcagaatggccaacctttaacgtcggatggccgcgagacggcacctttaaccgagacctcatcacccaggttaagatcaaggtcttttcacctggcccgcatggacacccagaccaggtcccctacatcgtgacctgggaagccttggcttttgacccccctccctgggtcaagccctttgtacaccctaagcctccgcctcctcttcctccatccgccccgtctctcccccttgaacctcctcgttcgaccccgcctcgatcctccctttatccagccctcactccttctctaggcgccaaacctaaacctcaagttctttctgacagtggggggccgctcatcgacctacttacagaagaccccccgccttatagggacccaagaccacccccttccgacagggacggaaatggtggagaagcgacccctgcgggagaggcaccggacccctccccaatggcatctcgcctacgtgggagacgggagccccctgtggccgactccactacctcgcaggcattccccctccgcgcaggaggaaacggacagcttcaatactggccgttctcctcttctgacctttacaactggaaaaataataacccttctttttctgaagatccaggtaaactgacagctctgatcgagtctgttctcatcacccatcagcccacctgggacgactgtcagcagctgttggggactctgctgaccggagaagaaaaacaacgggtgctcttagaggctagaaaggcggtgcggggcgatgatgggcgccccactcaactgcccaatgaagtcgatgccgcttttcccctcgagcgcccagactgggattacaccacccaggcaggtaggaaccacctagtccactatcgccagttgctcctagcgggtctccaaaacgcgggcagaagccccaccaatttggccaaggtaaaaggaataacacaagggcccaatgagtctccctcggccttcctagagagacttaaggaagcctatcgcaggtacactccttatgaccctgaggacccagggcaagaaactaatgtgtctatgtctttcatttggcagtctgccccagacattgggagaaagttagagaggttagaagatttaaaaaacaagacgcttggagatttggttagagaggcagaaaagatctttaataaacgagaaaccccggaagaaagagaggaacgtatcaggagagaaacagaggaaaaagaagaacgccgtaggacagaggatgagcagaaagagaaagaaagagatcgtaggagacatagagagatgagcaagctattggccactgtcgttagtggacagaaacaggatagacagggaggagaacgaaggaggtcccaactcgatcgcgaccagtgtgcctactgcaaagaaaaggggcactgggctaaagattgtcccaagaaaccacgaggacctcggggaccaagaccccagacctccctcctgaccctagatgactagggaggtcagggtcaggagcccccccctgaacccaggataaccctcaaagtcggggggcaacccgtcaccttcctggtagatactggggcccaacactccgtgctgacccaaaatcctggacccctaagtgataagtctgcctgggtccaaggggctactggaggaaagcggtatcgctggaccacggatcgcaaagtacatctagctaccggtaaggtcacccactctttcctccatgtaccagactgtccctatcctctgttaggaagagatttgctgactaaactaaaagcccaaatccactttgagggatcaggagctcaggttatgggaccaatggggcagcccctgcaagtgttgaccctaaatatagaagatgagcatcggctacatgagacctcaaaagagccagatgtttctctagggtccacatggctgtctgattttcctcaggcctgggcggaaaccgggggcatgggactggcagttcgccaagctcctctgatcatacctctgaaagcaacctctacccccgtgtccataaaacaataccccatgtcacaagaagccagactggggatcaagccccacatacagagactgttggaccagggaatactggtcgggacatcaaaaaggaaacagcgcagaggccaggggcaaccggatggccgaccaagcggcccgagaagtagccactagagaaactccaggaacttccacacttctgatagaaaactcaaccccctatacccatgaacactttcactatacagtaactgacacaaaggatttgaccaaactaggagccacttatgacagtgcgaagaaatattgggtctatcaaggaaagcctgttatgcctgatcaattcacctttgagttactagactttcttcaccaattgacccacctcagcttctcaaaaacaaaggctctcctagagagaagccccagtccctactacatgctgaaccgggatcgaacactcaaaaatatcactgagacctgcaaagcttgtgcacaagtcaatgccagcaagtctgccgttaagcaaggaactagggtccgcgggcatcggcctggcacacactgggagatcgatttcaccgaggtaaaacctggattgtatggctataagtatcttttagtttttgtagatactttttctggctggatagaagctttcccaactaagaaagaaaccgccaaggtcgtgaccaagaaactgctagaagagatcttccctaggttcggcatgccgcaggtattgggaactgacaatgggcctgccttcgtctccaaggtgagtcagacagtggccgatctgttggggattgattggaaattacattgtgcatacagaccccaaagctcaggtcaggtagaaagaatgaataggaccatcaaggagactttaactaaattaacgcttgcaactggctctagagactgggtgctcctactccccttagccctgtaccgagcccgcaacacgccgggcccccatggcctcaccccatatgagatcttatatggggcacccccgccccttgtaaacttccctgaccctgacatgaccagagttactaacagcccctctctccaagctcacttacaggctctctacttagtccagcacgaagtttggagaccactggcggcagcttaccaagaacaactggaccggccggtggtgcctcacccttaccgggtcggcgacacagtgtgggtccgccgacatcaaaccaagaacctagaacctcgctggaaaggaccttacacagtcctgctgaccacccccaccgccctcaaagtagacggtatcgcagcttggatacacgcagcccacgtaaaggcggccgacaccgagagtggaccatcctctggacggacatggcgcgttcaacgctctcaaaaccccctcaagataagattaacccgtggaagcccttaaaagctcgaggccgccccggtgaccttcagaccttggcactggaggtggcccggcagaagcgcggcatcgtggatcagtgctgcaccagcatctgctctctctaccaactggagaactactgcaactaggcccaccactaccctgtccacccctctgcaatgaataaaacctttgaaagagcactacaagttgtgtgtacatgcgtgcatgtgcatatgtggtgcggggggaacatgagtggggctggctggagtggcgatgataagctgtcaaacatgagaattaattcttgaagacgaaagggcctcgtgatacgcctatttttataggttaatgtcatgataataatggtttcttagtctagaattaattccgtgtattctatagtgtcacctaaatcgtatgtgtatgatacataaggttatgtattaattgtagccgcgttctaacgacaatatgtacaagcctaattgtgtagcatctggcttactgaagcagaccctatcatctctctcgtaaactgccgtcagagtcggtttggttggacgaaccttctgagtttctggtaacgccgtcccgcacccggaaatggtcagcgaaccaatcagcagggtcatcgctagccagatcctctacgccggacgcatcgtggccggcatcaccggcgccacaggtgcggttgctggcgcctatatcgccgacatcaccgatggggaagatcgggctcgccacttcgggctcatgagcgcttgtttcggcgtgggtatggtggcaggccccgtggccgggggactgttgggcgccatctccttgcatgcaccattccttgcggcggcggtgctcaacggcctcaacctactactgggctgcttcctaatgcaggagtcgcataagggagagcgtcgaatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcacatgagcgaaaaatacatcgtcacctgggacatgttgcagatccatgcacgtaaactcgcaagccgactgatgccttctgaacaatggaaaggcattattgccgtaagccgtggcggtctgtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaatcttttcaacgcctggcactgccgggcgttgttctttttaacttcaggcgggttacaatagtttccagtaagtattctggaggctgcatccatgacacaggcaaacctgagcgaaaccctgttcaaaccccgctttaaacatcctgaaacctcgacgctagtccgccgctttaatcacggcgcacaaccgcctgtgcagtcggcccttgatggtaaaaccatccctcactggtatcgcatgattaaccgtctgatgtggatctggcgcggcattgacccacgcgaaatcctcgacgtccaggcacgtattgtgatgagcgatgccgaacgtaccgacgatgatttatacgatacggtgattggctaccgtggcggcaactggatttatgagtgggccccggatctttgtgaaggaaccttacttctgtggtgtgacataattggacaaactacctacagagatttaaagctctaaggtaaatataaaatttttaacccggatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccaaaaaagaagagaaaggtagaagaccccaaggactttccttcagaattgctaagttttttgagtcatgctgtgtttagtaatagaactcttgcttgctttgctatttacaccacaaaggaaaaagctgcactgctatacaagaaaattatggaaaaatattctgtaacctttataagtaggcataacagttataatcataacatactgttttttcttactccacacaggcatagagtgtctgctattaataactatgctcaaaaattgtgtacctttagctttttaatttgtaaaggggttaataaggaatatttgatgtatagtgccttgactagagatcataatcagccataccacatttgtagaggttttacttgctttaaaaaacctcccacacctccccctgaacctgaaacataaaatgaatgcaattgttgttgttgggctgcaggaattaattcgagctcgcccgaca

SEQ ID NO: 64 - DNA, 8010 bp, Artificial sequence
  SEQ ID NO: 64
ttgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagagtctataggcccacccccttggcttcttatgcgacggatcgatcccgtaataagcttcgaggtccgcggccggccgcgttgacgcgcacggcaagaggcgaggggcggcgactggtgagagatgggccagactgttaccactcccttaagtttgaccttaggtcactggaaagatgtcgagcggatcgctcacaaccagtcggtagatgtcaagaagagacgttgggttaccttctgctctgcagaatggccaacctttaacgtcggatggccgcgagacggcacctttaaccgagacctcatcacccaggttaagatcaaggtcttttcacctggcccgcatggacacccagaccaggtcccctacatcgtgacctgggaagccttggcttttgacccccctccctgggtcaagccctttgtacaccctaagcctccgcctcctcttcctccatccgccccgtctctcccccttgaacctcctcgttcgaccccgcctcgatcctccctttatccagccctcactccttctctaggcgccaaacctaaacctcaagttctttctgacagtggggggccgctcatcgacctacttacagaagaccccccgccttatagggacccaagaccacccccttccgacagggacggaaatggtggagaagcgacccctgcgggagaggcaccggacccctccccaatggcatctcgcctacgtgggagacgggagccccctgtggccgactccactacctcgcaggcattccccctccgcgcaggaggaaacggacagcttcaatactggccgttctcctcttctgacctttacaactggaaaaataataacccttctttttctgaagatccaggtaaactgacagctctgatcgagtctgttctcatcacccatcagcccacctgggacgactgtcagcagctgttggggactctgctgaccggagaagaaaaacaacgggtgctcttagaggctagaaaggcggtgcggggcgatgatgggcgccccactcaactgcccaatgaagtcgatgccgcttttcccctcgagcgcccagactgggattacaccacccaggcaggtaggaaccacctagtccactatcgccagttgctcctagcgggtctccaaaacgcgggcagaagccccaccaatttggccaaggtaaaaggaataacacaagggcccaatgagtctccctcggccttcctagagagacttaaggaagcctatcgcaggtacactccttatgaccctgaggacccagggcaagaaactaatgtgtctatgtctttcatttggcagtctgccccagacattgggagaaagttagagaggttagaagatttaaaaaacaagacgcttggagatttggttagagaggcagaaaagatctttaataaacgagaaaccccggaagaaagagaggaacgtatcaggagagaaacagaggaaaaagaagaacgccgtaggacagaggatgagcagaaagagaaagaaagagatcgtaggagacatagagagatgagcaagctattggccactgtcgttagtggacagaaacaggatagacagggaggagaacgaaggaggtcccaactcgatcgcgaccagtgtgcctactgcaaagaaaaggggcactgggctaaagattgtcccaagaaaccacgaggacctcggggaccaagaccccagacctccctcctgaccctagatgactagggaggtcagggtcaggagcccccccctgaacccaggataaccctcaaagtcggggggcaacccgtcaccttcctggtagatactggggcccaacactccgtgctgacccaaaatcctggacccctaagtgataagtctgcctgggtccaagggggaggccgccccggtgaccttcagaccttggcactggaggtggcccggcagaagcgcggcatcgtggatcagtgctgcaccagcatctgctctctctaccaactggagaactactgcaactaggcccaccactaccctgtccacccctctgcaatgaataaaacctttgaaagagcactacaagttgtgtgtacatgcgtgcatgtgcatatgtggtgcggggggaacatgagtggggctggctggagtggcgatgataagctgtcaaacatgagaattaattcttgaagacgaaagggcctcgtgatacgcctatttttataggttaatgtcatgataataatggtttcttagtctagaattaattccgtgtattctatagtgtcacctaaatcgtatgtgtatgatacataaggttatgtattaattgtagccgcgttctaacgacaatatgtacaagcctaattgtgtagcatctggcttactgaagcagaccctatcatctctctcgtaaactgccgtcagagtcggtttggttggacgaaccttctgagtttctggtaacgccgtcccgcacccggaaatggtcagcgaaccaatcagcagggtcatcgctagccagatcctctacgccggacgcatcgtggccggcatcaccggcgccacaggtgcggttgctggcgcctatatcgccgacatcaccgatggggaagatcgggctcgccacttcgggctcatgagcgcttgtttcggcgtgggtatggtggcaggccccgtggccgggggactgttgggcgccatctccttgcatgcaccattccttgcggcggcggtgctcaacggcctcaacctactactgggctgcttcctaatgcaggagtcgcataagggagagcgtcgaatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcacatgagcgaaaaatacatcgtcacctgggacatgttgcagatccatgcacgtaaactcgcaagccgactgatgccttctgaacaatggaaaggcattattgccgtaagccgtggcggtctgtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaatcttttcaacgcctggcactgccgggcgttgttctttttaacttcaggcgggttacaatagtttccagtaagtattctggaggctgcatccatgacacaggcaaacctgagcgaaaccctgttcaaaccccgctttaaacatcctgaaacctcgacgctagtccgccgctttaatcacggcgcacaaccgcctgtgcagtcggcccttgatggtaaaaccatccctcactggtatcgcatgattaaccgtctgatgtggatctggcgcggcattgacccacgcgaaatcctcgacgtccaggcacgtattgtgatgagcgatgccgaacgtaccgacgatgatttatacgatacggtgattggctaccgtggcggcaactggatttatgagtgggccccggatctttgtgaaggaaccttacttctgtggtgtgacataattggacaaactacctacagagatttaaagctctaaggtaaatataaaatttttaacccggatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccaaaaaagaagagaaaggtagaagaccccaaggactttccttcagaattgctaagttttttgagtcatgctgtgtttagtaatagaactcttgcttgctttgctatttacaccacaaaggaaaaagctgcactgctatacaagaaaattatggaaaaatattctgtaacctttataagtaggcataacagttataatcataacatactgttttttcttactccacacaggcatagagtgtctgctattaataactatgctcaaaaattgtgtacctttagctttttaatttgtaaaggggttaataaggaatatttgatgtatagtgccttgactagagatcataatcagccataccacatttgtagaggttttacttgctttaaaaaacctcccacacctccccctgaacctgaaacataaaatgaatgcaattgttgttgttgggctgcaggaattaattcgagctcgcccgaca

SEQ ID NO: 65 - DNA, 12150 bp, Artificial sequence
  SEQ ID NO: 65
cagttagagaaagaacccataataggagcagaaactttctatgtagatggggcagccaatagggaaactaaattaggaaaagcaggatatgtaactgacagaggaagacaaaaagttgtccccctaacggacacaacaaatcagaagactcagttacaagcaattcatctagctttgcaggattcgggattagaagtaaacatagtgacagactcacaatatgcattgggaatcattcaagcacaaccagataagagtgaatcagagttagtcagtcaaataatagagcagttaataaaaaaggaaaaagtctacctggcatgggtaccagcacacaaaggaattggaggaaatgaacaagtagataaattggtcagtgctggaatcaggaaagtactatttttagatggaatagataaggcccaagaagaacatgagaaatatcacagtaattggagagcaatggctagtgattttaacctaccacctgtagtagcaaaagaaatagtagccagctgtgataaatgtcagctaaaaggggaagccatgcatggacaagtagactgtagcccaggaatatggcagctagattgtacacatttagaaggaaaagttatcttggtagcagttcatgtagccagtggatatatagaagcagaagtaattccagcagagacagggcaagaaacagcatacttcctcttaaaattagcaggaagatggccagtaaaaacagtacatacagacaatggcagcaatttcaccagtactacagttaaggccgcctgttggtgggcggggatcaagcaggaatttggcattccctacaatccccaaagtcaaggagtaatagaatctatgaataaagaattaaagaaaattataggacaggtaagagatcaggctgaacatcttaagacagcagtacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggaaaggaccagcaaagctcctctggaaaggtgaaggggcagtagtaatacaagataatagtgacataaaagtagtgccaagaagaaaagcaaagatcatcagggattatggaaaacagatggcaggtgatgattgtgtggcaagtagacaggatgaggattaacacatggaattctgcaacaactgctgtttatccatttcagaattgggtgtcgacatagcagaataggcgttactcgacagaggagagcaagaaatggagccagtagatcctagactagagccctggaagcatccaggaagtcagcctaaaactgcttgtaccaattgctattgtaaaaagtgttgctttcattgccaagtttgtttcatgacaaaagccttaggcatctcctatggcaggaagaagcggagacagcgacgaagagctcatcagaacagtcagactcatcaagcttctctatcaaagcagtaagtagtacatgtaatgcaacctataatagtagcaatagtagcattagtagtagcaataataatagcaatagttgtgtggtccatagtaatcatagaatataggaaaatggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatccttggcacttatctgggacgatctgcggagcctgtgcctcttcagctaccaccgcttgagagacttactcttgattgtaacgaggattgtggaacttctgggacgcagggggtgggaagccctcaaatattggtggaatctcctacaatattggagtcaggagctaaagaatagtgctgttagcttgctcaatgccacagccatagcagtagctgaggggacagatagggttatagaagtagtacaaggagcttgtagagctattcgccacatacctagaagaataagacagggcttggaaaggattttgctataagctcgaggccgccccggtgaccttcagaccttggcactggaggtggcccggcagaagcgcggcatcgtggatcagtgctgcaccagcatctgctctctctaccaactggagaactactgcaactaggcccaccactaccctgtccacccctctgcaatgaataaaacctttgaaagagcactacaagttgtgtgtacatgcgtgcatgtgcatatgtggtgcggggggaacatgagtggggctggctggagtggcgatgataagctgtcaaacatgagaattaattcttgaagacgaaagggcctcgtgatacgcctatttttataggttaatgtcatgataataatggtttcttagtctagaattaattccgtgtattctatagtgtcacctaaatcgtatgtgtatgatacataaggttatgtattaattgtagccgcgttctaacgacaatatgtacaagcctaattgtgtagcatctggcttactgaagcagaccctatcatctctctcgtaaactgccgtcagagtcggtttggttggacgaaccttctgagtttctggtaacgccgtcccgcacccggaaatggtcagcgaaccaatcagcagggtcatcgctagccagatcctctacgccggacgcatcgtggccggcatcaccggcgccacaggtgcggttgctggcgcctatatcgccgacatcaccgatggggaagatcgggctcgccacttcgggctcatgagcgcttgtttcggcgtgggtatggtggcaggccccgtggccgggggactgttgggcgccatctccttgcatgcaccattccttgcggcggcggtgctcaacggcctcaacctactactgggctgcttcctaatgcaggagtcgcataagggagagcgtcgaatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcacatgagcgaaaaatacatcgtcacctgggacatgttgcagatccatgcacgtaaactcgcaagccgactgatgccttctgaacaatggaaaggcattattgccgtaagccgtggcggtctgtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaatcttttcaacgcctggcactgccgggcgttgttctttttaacttcaggcgggttacaatagtttccagtaagtattctggaggctgcatccatgacacaggcaaacctgagcgaaaccctgttcaaaccccgctttaaacatcctgaaacctcgacgctagtccgccgctttaatcacggcgcacaaccgcctgtgcagtcggcccttgatggtaaaaccatccctcactggtatcgcatgattaaccgtctgatgtggatctggcgcggcattgacccacgcgaaatcctcgacgtccaggcacgtattgtgatgagcgatgccgaacgtaccgacgatgatttatacgatacggtgattggctaccgtggcggcaactggatttatgagtgggccccggatctttgtgaaggaaccttacttctgtggtgtgacataattggacaaactacctacagagatttaaagctctaaggtaaatataaaatttttaacccggatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccaaaaaagaagagaaaggtagaagaccccaaggactttccttcagaattgctaagttttttgagtcatgctgtgtttagtaatagaactcttgcttgctttgctatttacaccacaaaggaaaaagctgcactgctatacaagaaaattatggaaaaatattctgtaacctttataagtaggcataacagttataatcataacatactgttttttcttactccacacaggcatagagtgtctgctattaataactatgctcaaaaattgtgtacctttagctttttaatttgtaaaggggttaataaggaatatttgatgtatagtgccttgactagagatcataatcagccataccacatttgtagaggttttacttgctttaaaaaacctcccacacctccccctgaacctgaaacataaaatgaatgcaattgttgttgttgggctgcaggaattaattcgagctcgcccgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagagtctataggcccacccccttggcttcttatgcgacggatcgatcccgtaataagcttcgaggtccgcggccggccgcgttgacgcgcacggcaagaggcgaggggcggcgactggtgagagatgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaataaagataggggggcaattaaaggaagctctattagatacaggagcagatgatacagtattagaagaaatgaatttgccaggaagatggaaaccaaaaatgatagggggaattggaggttttatcaaagtaagacagtatgatcagatactcatagaaatctgcggacataaagctataggtacagtattagtaggacctacacctgtcaacataattggaagaaatctgttgactcagattggctgcactttaaattttcccattagtcctattgagactgtaccagtaaaattaaagccaggaatggatggcccaaaagttaaacaatggccattgacagaagaaaaaataaaagcattagtagaaatttgtacagaaatggaaaaggaaggaaaaatttcaaaaattgggcctgaaaatccatacaatactccagtatttgccataaagaaaaaagacagtactaaatggagaaaattagtagatttcagagaacttaataagagaactcaagatttctgggaagttcaattaggaataccacatcctgcagggttaaaacagaaaaaatcagtaacagtactggaggtgggcgatgcatatttttcagttcccttagataaagacttcaggaagtatactgcatttaccatacctagtataaacaatgagacaccagggattagatatcagtacaatgtgcttccacagggatggaaaggatcaccagcaatattccagtgtagcatgacaaaaatcttagagccttttagaaaacaaaatccagacatagtcatctatcaatacatggatgatttgtatgtaggatctgacttagaaatagggcagcatagaacaaaaatagaggaactgagacaacatctgttgaggtggggatttaccacaccagacaaaaaacatcagaaagaacctccattcctttggatgggttatgaactccatcctgataaatggacagtacagcctatagtgctgccagaaaaggacagctggactgtcaatgacatacagaaattagtgggaaaattgaattgggcaagtcagatttatgcagggattaaagtaaggcaattatgtaaacttcttaggggaaccaaagcactaacagaagtagtaccactaacagaagaagcagagctagaactggcagaaaacagggagattctaaaagaaccggtacatggagtgtattatgacccatcaaaagacttaatagcagaaatacagaagcaggggcaaggccaatggacatatcaaatttatcaagagccatttaaaaatctgaaaacaggaaagtatgcaagaatgaagggtgcccacactaatgatgtgaaacaattaacagaggcagtacaaaaaatagccacagaaagcatagtaatatggggaaagactcctaaatttaaattacccatacaaaaggaaacatgggaagcatggtggacagagtattggcaagccacctggattcctgagtgggagtttgtcaatacccctcccttagtgaagttatggtac

SEQ ID NO: 66 - DNA, 11057 bp, Artificial sequence
  SEQ ID NO: 66
ccagatcctctacgccggacgcatcgtggccggcatcaccggcgccacaggtgcggttgctggcgcctatatcgccgacatcaccgatggggaagatcgggctcgccacttcgggctcatgagcgcttgtttcggcgtgggtatggtggcaggccccgtggccgggggactgttgggcgccatctccttgcatgcaccattccttgcggcggcggtgctcaacggcctcaacctactactgggctgcttcctaatgcaggagtcgcataagggagagcgtcgaatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcacatgagcgaaaaatacatcgtcacctgggacatgttgcagatccatgcacgtaaactcgcaagccgactgatgccttctgaacaatggaaaggcattattgccgtaagccgtggcggtctgtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaatcttttcaacgcctggcactgccgggcgttgttctttttaacttcaggcgggttacaatagtttccagtaagtattctggaggctgcatccatgacacaggcaaacctgagcgaaaccctgttcaaaccccgctttaaacatcctgaaacctcgacgctagtccgccgctttaatcacggcgcacaaccgcctgtgcagtcggcccttgatggtaaaaccatccctcactggtatcgcatgattaaccgtctgatgtggatctggcgcggcattgacccacgcgaaatcctcgacgtccaggcacgtattgtgatgagcgatgccgaacgtaccgacgatgatttatacgatacggtgattggctaccgtggcggcaactggatttatgagtgggccccggatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccaaaaaagaagagaaaggtagaagaccccaaggactttccttcagaattgctaagttttttgagtcatgctgtgtttagtaatagaactcttgcttgctttgctatttacaccacaaaggaaaaagctgcactgctatacaagaaaattatggaaaaatattctgtaacctttataagtaggcataacagttataatcataacatactgttttttcttactccacacaggcatagagtgtctgctattaataactatgctcaaaaattgtgtacctttagctttttaatttgtaaaggggttaataaggaatatttgatgtatagtgccttgactagagatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatcaactggataactcaagctaaccaaaatcatcccaaacttcccaccccataccctattaccactgccaattacctagtggtttcatttactctaaacctgtgattcctctgaattattttcattttaaagaaattgtatttgttaaatatgtactacaaacttagtagttggaagggctaattcactcccaacgaagacaagatatccttgatctgtggatctaccacacacaaggctacttccctgattagcagaactacacaccagggccagggatcagatatccactgacctttggatggtgctacaagctagtaccagttgagccagagaagttagaagaagccaacaaaggagagaacaccagcttgttacaacctgtgagcctgcatgggatggatgacccggagagagaagtgttagagtggaggtttgacagccgcctagcatttcatcacggtggcccgagagctgcatccggagtacttcaagaactgctgatatcgagcttgctacaagggactttccgctgggggactttccagggaggcgtggcctgggcgggactggggagtggcgagccctcagatcctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctagcaccgtcgacgatgtaggtcacggtctcgaagccgcggtgcgggtgccagggcgtgcccttgggctccccgggcgcgtactccacctcacccatctggtccatcatgatgaacgggtcgaggtggcggtagttgatcccggcgaacgcgcggcgcaccgggaagccctcgccctcgaaaccgctgggcgcggtggtcacggtgagcacgggacgtgcgacggcgtcggcgggtgcggatacgcggggcagcgtcagcgggttctcgacggtcacggcgggcatgtcgacgaattcacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccactttggctgatatcgagatcagcttggcattccggtactgttggtaaagccaccatggaagacgccaaaaacataaagaaaggcccggcgccattctatccgctggaagatggaaccgctggagagcaactgcataaggctatgaagagatacgccctggttcctggaacaattgcttttacagatgcacatatcgaggtggacatcacttacgctgagtacttcgaaatgtccgttcggttggcagaagctatgaaacgatatgggctgaatacaaatcacagaatcgtcgtatgcagtgaaaactctcttcaattctttatgccggtgttgggcgcgttatttatcggagttgcagttgcgcccgcgaacgacatttataatgaacgtgaattgctcaacagtatgggcatttcgcagcctaccgtggtgttcgtttccaaaaaggggttgcaaaaaattttgaacgtgcaaaaaaagctcccaatcatccaaaaaattattatcatggattctaaaacggattaccagggatttcagtcgatgtacacgttcgtcacatctcatctacctcccggttttaatgaatacgattttgtgccagagtccttcgatagggacaagacaattgcactgatcatgaactcctctggatctactggtctgcctaaaggtgtcgctctgcctcatagaactgcctgcgtgagattctcgcatgccagagatcctatttttggcaatcaaatcattccggatactgcgattttaagtgttgttccattccatcacggttttggaatgtttactacactcggatatttgatatgtggatttcgagtcgtcttaatgtatagatttgaagaagagctgtttctgaggagccttcaggattacaagattcaaagtgcgctgctggtgccaaccctattctccttcttcgccaaaagcactctgattgacaaatacgatttatctaatttacacgaaattgcttctggtggcgctcccctctctaaggaagtcggggaagcggttgccaagaggttccatctgccaggtatcaggcaaggatatgggctcactgagactacatcagctattctgattacacccgagggggatgataaaccgggcgcggtcggtaaagttgttccattttttgaagcgaaggttgtggatctggataccgggaaaacgctgggcgttaatcaaagaggcgaactgtgtgtgagaggtcctatgattatgtccggttatgtaaacaatccggaagcgaccaacgccttgattgacaaggatggatggctacattctggagacatagcttactgggacgaagacgaacacttcttcatcgttgaccgcctgaagtctctgattaagtacaaaggctatcaggtggctcccgctgaattggaatccatcttgctccaacaccccaacatcttcgacgcaggtgtcgcaggtcttcccgacgatgacgccggtgaacttcccgccgccgttgttgttttggagcacggaaagacgatgacggaaaaagagatcgtggattacgtcgccagtcaagtaacaaccgcgaaaaagttgcgcggaggagttgtgtttgtggacgaagtaccgaaaggtcttaccggaaaactcgacgcaagaaaaatcagagagatcctcataaaggccaagaagggcggaaagatcgccgtgtaattctagtagtggccaggatccgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcatcggggtacctttaagaccaatgacttacaaggcagctgtagatcttagccactttttaaaagaaaaggggggactggaagggctaattcactcccaacgaagacaagatcgtcgagagatgctgcatataagcagctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtagtagttcatgtcatcttattattcagtatttataacttgcaaagaaatgaatatcagagagtgagaggccttgacattataatagatttagcaggaattgaactaggagtggagcacacaggcaaagctgcagaagtacttggaagaagccaccagagatactcacgattctgcacatacctggctaatcccagatcctaaggattacattaagtttactaacatttatataatgatttatagtttaaagtataaacttatctaatttactattctgacagatattaattaatcctcaaatatcataagagatgattactattatccccatttaacacaagaggaaactgagagggaaagatgttgaagtaattttcccacaattacagcatccgttagttacgactctatgatcttctgacacaaattccatttactcctcaccctatgactcagtcgaatatatcaaagttatggacattatgctaagtaacaaattacccttttatatagtaaatactgagtagattgagagaagaaattgtttgcaaacctgaatagcttcaagaagaagagaagtgaggataagaataacagttgtcatttaacaagttttaacaagtaacttggttagaaagggattcaaatgcataaagcaagggataaatttttctggcaacaagactatacaatataaccttaaatatgacttcaaataattgttggaacttgataaaactaattaaatattattgaagattatcaatattataaatgtaatttacttttaaaaagggaacatagaaatgtgtatcattagagtagaaaacaatccttattatcacaatttgtcaaaacaagtttgttattaacacaagtagaatactgcattcaattaagttgactgcagattttgtgttttgttaaaattagaaagagataacaacaatttgaattattgaaagtaacatgtaaatagttctacatacgttcttttgacatcttgttcaatcattgatcgaagttctttatcttggaagaatttgttccaaagactctgaaataaggaaaacaatctattatatagtctcacacctttgttttacttttagtgatttcaatttaataatgtaaatggttaaaatttattcttctctgagatcatttcacattgcagatagaaaacctgagactggggtaatttttattaaaatctaatttaatctcagaaacacatctttattctaacatcaatttttccagtttgatattatcatataaagtcagccttcctcatctgcaggttccacaacaaaaatccaaccaactgtggatcaaaaatattgggaaaaaattaaaaatagcaatacaacaataaaaaaatacaaatcagaaaaacagcacagtataacaactttatttagcatttacaatctattaggtattataagtaatctag

SEQ ID NO: 67 - DNA, 10450 bp, Artificial sequence
  SEQ ID NO: 67
ccagatcctctacgccggacgcatcgtggccggcatcaccggcgccacaggtgcggttgctggcgcctatatcgccgacatcaccgatggggaagatcgggctcgccacttcgggctcatgagcgcttgtttcggcgtgggtatggtggcaggccccgtggccgggggactgttgggcgccatctccttgcatgcaccattccttgcggcggcggtgctcaacggcctcaacctactactgggctgcttcctaatgcaggagtcgcataagggagagcgtcgaatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcacatgagcgaaaaatacatcgtcacctgggacatgttgcagatccatgcacgtaaactcgcaagccgactgatgccttctgaacaatggaaaggcattattgccgtaagccgtggcggtctgtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaatcttttcaacgcctggcactgccgggcgttgttctttttaacttcaggcgggttacaatagtttccagtaagtattctggaggctgcatccatgacacaggcaaacctgagcgaaaccctgttcaaaccccgctttaaacatcctgaaacctcgacgctagtccgccgctttaatcacggcgcacaaccgcctgtgcagtcggcccttgatggtaaaaccatccctcactggtatcgcatgattaaccgtctgatgtggatctggcgcggcattgacccacgcgaaatcctcgacgtccaggcacgtattgtgatgagcgatgccgaacgtaccgacgatgatttatacgatacggtgattggctaccgtggcggcaactggatttatgagtgggccccggatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccaaaaaagaagagaaaggtagaagaccccaaggactttccttcagaattgctaagttttttgagtcatgctgtgtttagtaatagaactcttgcttgctttgctatttacaccacaaaggaaaaagctgcactgctatacaagaaaattatggaaaaatattctgtaacctttataagtaggcataacagttataatcataacatactgttttttcttactccacacaggcatagagtgtctgctattaataactatgctcaaaaattgtgtacctttagctttttaatttgtaaaggggttaataaggaatatttgatgtatagtgccttgactagagatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatcaactggataactcaagctaaccaaaatcatcccaaacttcccaccccataccctattaccactgccaattacctagtggtttcatttactctaaacctgtgattcctctgaattattttcattttaaagaaattgtatttgttaaatatgtactacaaacttagtagttggaagggctaattcactcccaacgaagacaagatatccttgatctgtggatctaccacacacaaggctacttccctgattagcagaactacacaccagggccagggatcagatatccactgacctttggatggtgctacaagctagtaccagttgagccagagaagttagaagaagccaacaaaggagagaacaccagcttgttacaacctgtgagcctgcatgggatggatgacccggagagagaagtgttagagtggaggtttgacagccgcctagcatttcatcacggtggcccgagagctgcatccggagtacttcaagaactgctgatatcgagcttgctacaagggactttccgctgggggactttccagggaggcgtggcctgggcgggactggggagtggcgagccctcagatcctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctagcaccgtcgacgatgtaggtcacggtctcgaagccgcggtgcgggtgccagggcgtgcccttgggctccccgggcgcgtactccacctcacccatctggtccatcatgatgaacgggtcgaggtggcggtagttgatcccggcgaacgcgcggcgcaccgggaagccctcgccctcgaaaccgctgggcgcggtggtcacggtgagcacgggacgtgcgacggcgtcggcgggtgcggatacgcggggcagcgtcagcgggttctcgacggtcacggcgggcatgtcgacgaattcacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccactttggctgatatcgagatcagcttggcattccggtactgttggtaaagccaccatggaagacgccaaaaacataaagaaaggcccggcgccattctatccgctggaagatggaaccgctggagagcaactgcataaggctatgaagagatacgccctggttcctggaacaattgcttttacagatgcacatatcgaggtggacatcacttacgctgagtacttcgaaatgtccgttcggttggcagaagctatgaaacgatatgggctgaatacaaatcacagaatcgtcgtatgcagtgaaaactctcttcaattctttatgccggtgttgggcgcgttatttatcggagttgcagttgcgcccgcgaacgacatttataatgaacgtgaattgctcaacagtatgggcatttcgcagcctaccgtggtgttcgtttccaaaaaggggttgcaaaaaattttgaacgtgcaaaaaaagctcccaatcatccaaaaaattattatcatggattctaaaacggattaccagggatttcagtcgatgtacacgttcgtcacatctcatctacctcccggttttaatgaatacgattttgtgccagagtccttcgatagggacaagacaattgcactgatcatgaactcctctggatctactggtctgcctaaaggtgtcgctctgcctcatagaactgcctgcgtgagattctcgcatgccagagatcctatttttggcaatcaaatcattccggatactgcgattttaagtgttgttccattccatcacggttttggaatgtttactacactcggatatttgatatgtggatttcgagtcgtcttaatgtatagatttgaagaagagctgtttctgaggagccttcaggattacaagattcaaagtgcgctgctggtgccaaccctattctccttcttcgccaaaagcactctgattgacaaatacgatttatctaatttacacgaaattgcttctggtggcgctcccctctctaaggaagtcggggaagcggttgccaagaggttccatctgccaggtatcaggcaaggatatgggctcactgagactacatcagctattctgattacacccgagggggatgataaaccgggcgcggtcggtaaagttgttccattttttgaagcgaaggttgtggatctggataccgggaaaacgctgggcgttaatcaaagaggcgaactgtgtgtgagaggtcctatgattatgtccggttatgtaaacaatccggaagcgaccaacgccttgattgacaaggatggatggctacattctggagacatagcttactgggacgaagacgaacacttcttcatcgttgaccgcctgaagtctctgattaagtacaaaggctatcaggtggctcccgctgaattggaatccatcttgctccaacaccccaacatcttcgacgcaggtgtcgcaggtcttcccgacgatgacgccggtgaacttcccgccgccgttgttgttttggagcacggaaagacgatgacggaaaaagagatcgtggattacgtcgccagtcaagtaacaaccgcgaaaaagttgcgcggaggagttgtgtttgtggacgaagtaccgaaaggtcttaccggaaaactcgacgcaagaaaaatcagagagatcctcataaaggccaagaagggcggaaagatcgccgtgtaattctagtagtggccagctttaagaccaatgacttacaaggcagctgtagatcttagccactttttaaaagaaaaggggggactggaagggctaattcactcccaacgaagacaagatcgtcgagagatgctgcatataagcagctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtagtagttcatgtcatcttattattcagtatttataacttgcaaagaaatgaatatcagagagtgagaggccttgacattataatagatttagcaggaattgaactaggagtggagcacacaggcaaagctgcagaagtacttggaagaagccaccagagatactcacgattctgcacatacctggctaatcccagatcctaaggattacattaagtttactaacatttatataatgatttatagtttaaagtataaacttatctaatttactattctgacagatattaattaatcctcaaatatcataagagatgattactattatccccatttaacacaagaggaaactgagagggaaagatgttgaagtaattttcccacaattacagcatccgttagttacgactctatgatcttctgacacaaattccatttactcctcaccctatgactcagtcgaatatatcaaagttatggacattatgctaagtaacaaattacccttttatatagtaaatactgagtagattgagagaagaaattgtttgcaaacctgaatagcttcaagaagaagagaagtgaggataagaataacagttgtcatttaacaagttttaacaagtaacttggttagaaagggattcaaatgcataaagcaagggataaatttttctggcaacaagactatacaatataaccttaaatatgacttcaaataattgttggaacttgataaaactaattaaatattattgaagattatcaatattataaatgtaatttacttttaaaaagggaacatagaaatgtgtatcattagagtagaaaacaatccttattatcacaatttgtcaaaacaagtttgttattaacacaagtagaatactgcattcaattaagttgactgcagattttgtgttttgttaaaattagaaagagataacaacaatttgaattattgaaagtaacatgtaaatagttctacatacgttcttttgacatcttgttcaatcattgatcgaagttctttatcttggaagaatttgttccaaagactctgaaataaggaaaacaatctattatatagtctcacacctttgttttacttttagtgatttcaatttaataatgtaaatggttaaaatttattcttctctgagatcatttcacattgcagatagaaaacctgagactggggtaatttttattaaaatctaatttaatctcagaaacacatctttattctaacatcaatttttccagtttgatattatcatataaagtcagccttcctcatctgcaggttccacaacaaaaatccaaccaactgtggatcaaaaatattgggaaaaaattaaaaatagcaatacaacaataaaaaaatacaaatcagaaaaacagcacagtataacaactttatttagcatttacaatctattaggtattataagtaatctag

SEQ ID NO: 68 - DNA, 12150 bp, Artificial sequence
  SEQ ID NO: 68
ttgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagagtctataggcccacccccttggcttcttatgcgacggatcgatcccgtaataagcttcgaggtccgcggccggccgcgttgacgcgcacggcaagaggcgaggggcggcgactggtgagagatgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaataaagataggggggcaattaaaggaagctctattagatacaggagcagatgatacagtattagaagaaatgaatttgccaggaagatggaaaccaaaaatgatagggggaattggaggttttatcaaagtaagacagtatgatcagatactcatagaaatctgcggacataaagctataggtacagtattagtaggacctacacctgtcaacataattggaagaaatctgttgactcagattggctgcactttaaattttcccattagtcctattgagactgtaccagtaaaattaaagccaggaatggatggcccaaaagttaaacaatggccattgacagaagaaaaaataaaagcattagtagaaatttgtacagaaatggaaaaggaaggaaaaatttcaaaaattgggcctgaaaatccatacaatactccagtatttgccataaagaaaaaagacagtactaaatggagaaaattagtagatttcagagaacttaataagagaactcaagatttctgggaagttcaattaggaataccacatcctgcagggttaaaacagaaaaaatcagtaacagtactggatgtgggcgatgcatatttttcagttcccttagataaagacttcaggaagtatactgcatttaccatacctagtataaacaatgagacaccagggattagatatcagtacaatgtgcttccacagggatggaaaggatcaccagcaatattccagtgtagcatgacaaaaatcttagagccttttagaaaacaaaatccagacatagtcatctatcaatacatggatgatttgtatgtaggatctgacttagaaatagggcagcatagaacaaaaatagaggaactgagacaacatctgttgaggtggggatttaccacaccagacaaaaaacatcagaaagaacctccattcctttggatgggttatgaactccatcctgataaatggacagtacagcctatagtgctgccagaaaaggacagctggactgtcaatgacatacagaaattagtgggaaaattgaattgggcaagtcagatttatgcagggattaaagtaaggcaattatgtaaacttcttaggggaaccaaagcactaacagaagtagtaccactaacagaagaagcagagctagaactggcagaaaacagggagattctaaaagaaccggtacatggagtgtattatgacccatcaaaagacttaatagcagaaatacagaagcaggggcaaggccaatggacatatcaaatttatcaagagccatttaaaaatctgaaaacaggaaagtatgcaagaatgaagggtgcccacactaatgatgtgaaacaattaacagaggcagtacaaaaaatagccacagaaagcatagtaatatggggaaagactcctaaatttaaattacccatacaaaaggaaacatgggaagcatggtggacagagtattggcaagccacctggattcctgagtgggagtttgtcaatacccctcccttagtgaagttatggtaccagttagagaaagaacccataataggagcagaaactttctatgtagatggggcagccaatagggaaactaaattaggaaaagcaggatatgtaactgacagaggaagacaaaaagttgtccccctaacggacacaacaaatcagaagactgagttacaagcaattcatctagctttgcaggattcgggattagaagtaaacatagtgacagactcacaatatgcattgggaatcattcaagcacaaccagataagagtgaatcagagttagtcagtcaaataatagagcagttaataaaaaaggaaaaagtctacctggcatgggtaccagcacacaaaggaattggaggaaatgaacaagtagataaattggtcagtgctggaatcaggaaagtactatttttagatggaatagataaggcccaagaagaacatgagaaatatcacagtaattggagagcaatggctagtgattttaacctaccacctgtagtagcaaaagaaatagtagccagctgtgataaatgtcagctaaaaggggaagccatgcatggacaagtagactgtagcccaggaatatggcagctagattgtacacatttagaaggaaaagttatcttggtagcagttcatgtagccagtggatatatagaagcagaagtaattccagcagagacagggcaagaaacagcatacttcctcttaaaattagcaggaagatggccagtaaaaacagtacatacagacaatggcagcaatttcaccagtactacagttaaggccgcctgttggtgggcggggatcaagcaggaatttggcattccctacaatccccaaagtcaaggagtaatagaatctatgaataaagaattaaagaaaattataggacaggtaagagatcaggctgaacatcttaagacagcagtacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggaaaggaccagcaaagctcctctggaaaggtgaaggggcagtagtaatacaagataatagtgacataaaagtagtgccaagaagaaaagcaaagatcatcagggattatggaaaacagatggcaggtgatgattgtgtggcaagtagacaggatgaggattaacacatggaattctgcaacaactgctgtttatccatttcagaattgggtgtcgacatagcagaataggcgttactcgacagaggagagcaagaaatggagccagtagatcctagactagagccctggaagcatccaggaagtcagcctaaaactgcttgtaccaattgctattgtaaaaagtgttgctttcattgccaagtttgtttcatgacaaaagccttaggcatctcctatggcaggaagaagcggagacagcgacgaagagctcatcagaacagtcagactcatcaagcttctctatcaaagcagtaagtagtacatgtaatgcaacctataatagtagcaatagtagcattagtagtagcaataataatagcaatagttgtgtggtccatagtaatcatagaatataggaaaatggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatccttggcacttatctgggacgatctgcggagcctgtgcctcttcagctaccaccgcttgagagacttactcttgattgtaacgaggattgtggaacttctgggacgcagggggtgggaagccctcaaatattggtggaatctcctacaatattggagtcaggagctaaagaatagtgctgttagcttgctcaatgccacagccatagcagtagctgaggggacagatagggttatagaagtagtacaaggagcttgtagagctattcgccacatacctagaagaataagacagggcttggaaaggattttgctataagctcgaggccgccccggtgaccttcagaccttggcactggaggtggcccggcagaagcgcggcatcgtggatcagtgctgcaccagcatctgctctctctaccaactggagaactactgcaactaggcccaccactaccctgtccacccctctgcaatgaataaaacctttgaaagagcactacaagttgtgtgtacatgcgtgcatgtgcatatgtggtgcggggggaacatgagtggggctggctggagtggcgatgataagctgtcaaacatgagaattaattcttgaagacgaaagggcctcgtgatacgcctatttttataggttaatgtcatgataataatggtttcttagtctagaattaattccgtgtattctatagtgtcacctaaatcgtatgtgtatgatacataaggttatgtattaattgtagccgcgttctaacgacaatatgtacaagcctaattgtgtagcatctggcttactgaagcagaccctatcatctctctcgtaaactgccgtcagagtcggtttggttggacgaaccttctgagtttctggtaacgccgtcccgcacccggaaatggtcagcgaaccaatcagcagggtcatcgctagccagatcctctacgccggacgcatcgtggccggcatcaccggcgccacaggtgcggttgctggcgcctatatcgccgacatcaccgatggggaagatcgggctcgccacttcgggctcatgagcgcttgtttcggcgtgggtatggtggcaggccccgtggccgggggactgttgggcgccatctccttgcatgcaccattccttgcggcggcggtgctcaacggcctcaacctactactgggctgcttcctaatgcaggagtcgcataagggagagcgtcgaatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcacatgagcgaaaaatacatcgtcacctgggacatgttgcagatccatgcacgtaaactcgcaagccgactgatgccttctgaacaatggaaaggcattattgccgtaagccgtggcggtctgtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaatcttttcaacgcctggcactgccgggcgttgttctttttaacttcaggcgggttacaatagtttccagtaagtattctggaggctgcatccatgacacaggcaaacctgagcgaaaccctgttcaaaccccgctttaaacatcctgaaacctcgacgctagtccgccgctttaatcacggcgcacaaccgcctgtgcagtcggcccttgatggtaaaaccatccctcactggtatcgcatgattaaccgtctgatgtggatctggcgcggcattgacccacgcgaaatcctcgacgtccaggcacgtattgtgatgagcgatgccgaacgtaccgacgatgatttatacgatacggtgattggctaccgtggcggcaactggatttatgagtgggccccggatctttgtgaaggaaccttacttctgtggtgtgacataattggacaaactacctacagagatttaaagctctaaggtaaatataaaatttttaacccggatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccaaaaaagaagagaaaggtagaagaccccaaggactttccttcagaattgctaagttttttgagtcatgctgtgtttagtaatagaactcttgcttgctttgctatttacaccacaaaggaaaaagctgcactgctatacaagaaaattatggaaaaatattctgtaacctttataagtaggcataacagttataatcataacatactgttttttcttactccacacaggcatagagtgtctgctattaataactatgctcaaaaattgtgtacctttagctttttaatttgtaaaggggttaataaggaatatttgatgtatagtgccttgactagagatcataatcagccataccacatttgtagaggttttacttgctttaaaaaacctcccacacctccccctgaacctgaaacataaaatgaatgcaattgttgttgttgggctgcaggaattaattcgagctcgcccgaca

SEQ ID NO: 69 - DNA, 10656 bp, Artificial sequence
  SEQ ID NO: 69
ccagatcctctacgccggacgcatcgtggccggcatcaccggcgccacaggtgcggttgctggcgcctatatcgccgacatcaccgatggggaagatcgggctcgccacttcgggctcatgagcgcttgtttcggcgtgggtatggtggcaggccccgtggccgggggactgttgggcgccatctccttgcatgcaccattccttgcggcggcggtgctcaacggcctcaacctactactgggctgcttcctaatgcaggagtcgcataagggagagcgtcgaatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcacatgagcgaaaaatacatcgtcacctgggacatgttgcagatccatgcacgtaaactcgcaagccgactgatgccttctgaacaatggaaaggcattattgccgtaagccgtggcggtctgtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaatcttttcaacgcctggcactgccgggcgttgttctttttaacttcaggcgggttacaatagtttccagtaagtattctggaggctgcatccatgacacaggcaaacctgagcgaaaccctgttcaaaccccgctttaaacatcctgaaacctcgacgctagtccgccgctttaatcacggcgcacaaccgcctgtgcagtcggcccttgatggtaaaaccatccctcactggtatcgcatgattaaccgtctgatgtggatctggcgcggcattgacccacgcgaaatcctcgacgtccaggcacgtattgtgatgagcgatgccgaacgtaccgacgatgatttatacgatacggtgattggctaccgtggcggcaactggatttatgagtgggccccggatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccaaaaaagaagagaaaggtagaagaccccaaggactttccttcagaattgctaagttttttgagtcatgctgtgtttagtaatagaactcttgcttgctttgctatttacaccacaaaggaaaaagctgcactgctatacaagaaaattatggaaaaatattctgtaacctttataagtaggcataacagttataatcataacatactgttttttcttactccacacaggcatagagtgtctgctattaataactatgctcaaaaattgtgtacctttagctttttaatttgtaaaggggttaataaggaatatttgatgtatagtgccttgactagagatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatcaactggataactcaagctaaccaaaatcatcccaaacttcccaccccataccctattaccactgccaattacctagtggtttcatttactctaaacctgtgattcctctgaattattttcattttaaagaaattgtatttgttaaatatgtactacaaacttagtagttggaagggctaattcactcccaaagaagacaagatatccttgatctgtggatctaccacacacaaggctacttccctgattagcagaactacacaccagggccaggggtcagatatccactgacctttggatggtgctacaagctagtaccagttgagccagataaggtagaagaggccaataaaggagagaacaccagcttgttacaccctgtgagcctgcatgggatggatgacccggagagagaagtgttagagtggaggtttgacagccgcctagcatttcatcacgtggcccgagagctgcatccggagtacttcaagaactgctgatatcgagcttgctacaagggactttccgctggggactttccagggaggcgtggcctgggcgggactggggagtggcgagccctcagatcctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgccgaattcacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccactttggctgatacgcggatctacgcgtggatctatgcccaagaagaagaggaaggtgtccaatttactgaccgtacaccaaaatttgcctgcattaccggtcgatgcaacgagtgatgaggttcgcaagaacctgatggacatgttcagggatcgccaggcgttttctgagcatacctggaaaatgcttctgtccgtttgccggtcgtgggcggcatggtgcaagttgaataaccggaaatggtttcccgcagaacctgaagatgttcgcgattatcttctatatcttcaggcgcgcggtctggcagtaaaaactatccagcaacatttgggccagctaaacatgcttcatcgtcggtccgggctgccacgaccaagtgacagcaatgctgtttcactggttatgcggcggatccgaaaagaaaacgttgatgccggtgaacgtgcaaaacaggctctagcgttcgaacgcactgatttcgaccaggttcgttcactcatggaaaatagcgatcgctgccaggatatacgtaatctggcatttctggggattgcttataacaccctgttacgtatagccgaaattgccaggatcagggttaaagatatctcacgtactgacggtgggagaatgttaatccatattggcagaacgaaaacgctggttagcaccgcaggtgtagagaaggcacttagcctggaggtaactaaactggtcgagcgatggatttccgtctctggtgtagctgatgatccgaataactacctgttttgccgggtcagaaaaaatggtgttgccgcgccatctgccaccagccagctatcaactcgcgccctggaagggatttttgaagcaactcatcgattgatttacggcgctaaggatgactctggtcagagatacctggcctggtctggacacagtgcccgtgtcggagccgcgcgagatatggcccgcgctggagtttcaataccggagatcatgcaagctggtggctggaccaatgtaaatattgtcatgaactatatccgtaacctggatagtgaaacaggggcaatggtgcgcctgctggaagatggcgattagctcgagctcaagcttcgaattcccgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcatcgggaattctgcagtcgacggtacctttaagaccaatgacttacaaggcagctgtagatcttagccactttttaaaagaaaaggggggactggaagggctaattcactcccaacgaagacaaaatcgtcgagagatgctgcatataagcagctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtagtagttcatgtcatcttattattcagtatttataacttgcaaagaaatgaatatcagagagtgagaggccttgacattataatagatttagcaggaattgaactaggagtggagcacacaggcaaagctgcagaagtacttggaagaagccaccagagatactcacgattctgcacatacctggctaatcccagatcctaaggattacattaagtttactaacatttatataatgatttatagtttaaagtataaacttatctaatttactattctgacagatattaattaatcctcaaatatcataagagatgattactattatccccatttaacacaagaggaaactgagagggaaagatgttgaagtaattttcccacaattacagcatccgttagttacgactctatgatcttctgacacaaattccatttactcctcaccctatgactcagtcgaatatatcaaagttatggacattatgctaagtaacaaattacccttttatatagtaaatactgagtagattgagagaagaaattgtttgcaaacctgaatagcttcaagaagaagagaagtgaggataagaataacagttgtcatttaacaagttttaacaagtaacttggttagaaagggattcaaatgcataaagcaagggataaatttttctggcaacaagactatacaatataaccttaaatatgacttcaaataattgttggaacttgataaaactaattaaatattattgaagattatcaatattataaatgtaatttacttttaaaaagggaacatagaaatgtgtatcattagagtagaaaacaatccttattatcacaatttgtcaaaacaagtttgttattaacacaagtagaatactgcattcaattaagttgactgcagattttgtgttttgttaaaattagaaagagataacaacaatttgaattattgaaagtaacatgtaaatagttctacatacgttcttttgacatcttgttcaatcattgatcgaagttctttatcttggaagaatttgttccaaagactctgaaataaggaaaacaatctattatatagtctcacacctttgttttacttttagtgatttcaatttaataatgtaaatggttaaaatttattcttctctgagatcatttcacattgcagatagaaaacctgagactggggtaatttttattaaaatctaatttaatctcagaaacacatctttattctaacatcaatttttccagtttgatattatcatataaagtcagccttcctcatctgcaggttccacaacaaaaatccaaccaactgtggatcaaaaatattgggaaaaaattaaaaatagcaatacaacaataaaaaaatacaaatcagaaaaacagcacagtataacaactttatttagcatttacaatctattaggtattataagtaatctag

SEQ ID NO: 70 - DNA, 10253 bp, Artificial sequence
  SEQ ID NO: 70
gatccgcggcccgggtcaccatctagatggccatatgatcgatacgtactagtctcgagctcaagcttcgaattcccgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcatcgggaattctgcagtcgacggtacctttaagaccaatgacttacaaggcagctgtagatcttagccactttttaaaagaaaaggggggactggaagggctaattcactcccaacgaagacaaaatcgtcgagagatgctgcatataagcagctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtagtagttcatgtcatcttattattcagtatttataacttgcaaagaaatgaatatcagagagtgagaggccttgacattataatagatttagcaggaattgaactaggagtggagcacacaggcaaagctgcagaagtacttggaagaagccaccagagatactcacgattctgcacatacctggctaatcccagatcctaaggattacattaagtttactaacatttatataatgatttatagtttaaagtataaacttatctaatttactattctgacagatattaattaatcctcaaatatcataagagatgattactattatccccatttaacacaagaggaaactgagagggaaagatgttgaagtaattttcccacaattacagcatccgttagttacgactctatgatcttctgacacaaattccatttactcctcaccctatgactcagtcgaatatatcaaagttatggacattatgctaagtaacaaattacccttttatatagtaaatactgagtagattgagagaagaaattgtttgcaaacctgaatagcttcaagaagaagagaagtgaggataagaataacagttgtcatttaacaagttttaacaagtaacttggttagaaagggattcaaatgcataaagcaagggataaatttttctggcaacaagactatacaatataaccttaaatatgacttcaaataattgttggaacttgataaaactaattaaatattattgaagattatcaatattataaatgtaatttacttttaaaaagggaacatagaaatgtgtatcattagagtagaaaacaatccttattatcacaatttgtcaaaacaagtttgttattaacacaagtagaatactgcattcaattaagttgactgcagattttgtgttttgttaaaattagaaagagataacaacaatttgaattattgaaagtaacatgtaaatagttctacatacgttcttttgacatcttgttcaatcattgatcgaagttctttatcttggaagaatttgttccaaagactctgaaataaggaaaacaatctattatatagtctcacacctttgttttacttttagtgatttcaatttaataatgtaaatggttaaaatttattcttctctgagatcatttcacattgcagatagaaaacctgagactggggtaatttttattaaaatctaatttaatctcagaaacacatctttattctaacatcaatttttccagtttgatattatcatataaagtcagccttcctcatctgcaggttccacaacaaaaatccaaccaactgtggatcaaaaatattgggaaaaaattaaaaatagcaatacaacaataaaaaaatacaaatcagaaaaacagcacagtataacaactttatttagcatttacaatctattaggtattataagtaatctagccagatcctctacgccggacgcatcgtggccggcatcaccggcgccacaggtgcggttgctggcgcctatatcgccgacatcaccgatggggaagatcgggctcgccacttcgggctcatgagcgcttgtttcggcgtgggtatggtggcaggccccgtggccgggggactgttgggcgccatctccttgcatgcaccattccttgcggcggcggtgctcaacggcctcaacctactactgggctgcttcctaatgcaggagtcgcataagggagagcgtcgaatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcacatgagcgaaaaatacatcgtcacctgggacatgttgcagatccatgcacgtaaactcgcaagccgactgatgccttctgaacaatggaaaggcattattgccgtaagccgtggcggtctgtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaatcttttcaacgcctggcactgccgggcgttgttctttttaacttcaggcgggttacaatagtttccagtaagtattctggaggctgcatccatgacacaggcaaacctgagcgaaaccctgttcaaaccccgctttaaacatcctgaaacctcgacgctagtccgccgctttaatcacggcgcacaaccgcctgtgcagtcggcccttgatggtaaaaccatccctcactggtatcgcatgattaaccgtctgatgtggatctggcgcggcattgacccacgcgaaatcctcgacgtccaggcacgtattgtgatgagcgatgccgaacgtaccgacgatgatttatacgatacggtgattggctaccgtggcggcaactggatttatgagtgggccccggatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccaaaaaagaagagaaaggtagaagaccccaaggactttccttcagaattgctaagttttttgagtcatgctgtgtttagtaatagaactcttgcttgctttgctatttacaccacaaaggaaaaagctgcactgctatacaagaaaattatggaaaaatattctgtaacctttataagtaggcataacagttataatcataacatactgttttttcttactccacacaggcatagagtgtctgctattaataactatgctcaaaaattgtgtacctttagctttttaatttgtaaaggggttaataaggaatatttgatgtatagtgccttgactagagatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatcaactggataactcaagctaaccaaaatcatcccaaacttcccaccccataccctattaccactgccaattacctagtggtttcatttactctaaacctgtgattcctctgaattattttcattttaaagaaattgtatttgttaaatatgtactacaaacttagtagttggaagggctaattcactcccaaagaagacaagatatccttgatctgtggatctaccacacacaaggctacttccctgattagcagaactacacaccagggccaggggtcagatatccactgacctttggatggtgctacaagctagtaccagttgagccagataaggtagaagaggccaataaaggagagaacaccagcttgttacaccctgtgagcctgcatgggatggatgacccggagagagaagtgttagagtggaggtttgacagccgcctagcatttcatcacgtggcccgagagctgcatccggagtacttcaagaactgctgatatcgagcttgctacaagggactttccgctggggactttccagggaggcgtggcctgggcgggactggggagtggcgagccctcagatcctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgccgaattcacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccactttggctgatacgcggatctacgcgtggatccttaaatgccgccaccatgaatttcttgctctcttgggtccactggtcccttgcactgctgctctatttgcaccacgcgaaatggtcacaagcagcgcctatggccgaagggggaggccagaaccaccatgaggttgtaaagtttatggatgtgtaccagagatcgtattgccatcctattgagacattggtcgacattttccaagaataccccgatgagatcgaatacatctttaagcccagctgtgtcccccttatgcgctgtggcgggtgttgtaatgatgagggacttgaatgtgtgcccaccgaggaaagcaatatcactatgcaaatcatgaggatcaagcctcatcagggtcaacacattggagagatgtcgttcctccagcataacaaatgtgaatgtagaccgaaaaaggaccgagctaggcaggagaatccgtgcgggccatgctccgaaagaaggaaacacctcttcgtgcaagacccccaaacgtgcaagtgtagttgcaaaaacacggattcaagatgcaaagcccggcaattggagttgaacgaacgcacatgccgttgcgacaaaccgcgtcgatgaggcgcg

SEQ ID NO: 71 - DNA, 9689 bp, Artificial sequence
  SEQ ID NO: 71
ttgtacaaagtggtgatgggtcaccatctagatggccatatgatcgatacgtactagtctcgacggtacctttaagaccaatgacttacaaggcagctgtagatcttagccactttttaaaagaaaaggggggactggaagggctaattcactcccaacgaagacaaaatcgtcgagagatgctgcatataagcagctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtagtagttcatgtcatcttattattcagtatttataacttgcaaagaaatgaatatcagagagtgagaggccttgacattataatagatttagcaggaattgaactaggagtggagcacacaggcaaagctgcagaagtacttggaagaagccaccagagatactcacgattctgcacatacctggctaatcccagatcctaaggattacattaagtttactaacatttatataatgatttatagtttaaagtataaacttatctaatttactattctgacagatattaattaatcctcaaatatcataagagatgattactattatccccatttaacacaagaggaaactgagagggaaagatgttgaagtaattttcccacaattacagcatccgttagttacgactctatgatcttctgacacaaattccatttactcctcaccctatgactcagtcgaatatatcaaagttatggacattatgctaagtaacaaattacccttttatatagtaaatactgagtagattgagagaagaaattgtttgcaaacctgaatagcttcaagaagaagagaagtgaggataagaataacagttgtcatttaacaagttttaacaagtaacttggttagaaagggattcaaatgcataaagcaagggataaatttttctggcaacaagactatacaatataaccttaaatatgacttcaaataattgttggaacttgataaaactaattaaatattattgaagattatcaatattataaatgtaatttacttttaaaaagggaacatagaaatgtgtatcattagagtagaaaacaatccttattatcacaatttgtcaaaacaagtttgttattaacacaagtagaatactgcattcaattaagttgactgcagattttgtgttttgttaaaattagaaagagataacaacaatttgaattattgaaagtaacatgtaaatagttctacatacgttcttttgacatcttgttcaatcattgatcgaagttctttatcttggaagaatttgttccaaagactctgaaataaggaaaacaatctattatatagtctcacacctttgttttacttttagtgatttcaatttaataatgtaaatggttaaaatttattcttctctgagatcatttcacattgcagatagaaaacctgagactggggtaatttttattaaaatctaatttaatctcagaaacacatctttattctaacatcaatttttccagtttgatattatcatataaagtcagccttcctcatctgcaggttccacaacaaaaatccaaccaactgtggatcaaaaatattgggaaaaaattaaaaatagcaatacaacaataaaaaaatacaaatcagaaaaacagcacagtataacaactttatttagcatttacaatctattaggtattataagtaatctagccagatcctctacgccggacgcatcgtggccggcatcaccggcgccacaggtgcggttgctggcgcctatatcgccgacatcaccgatggggaagatcgggctcgccacttcgggctcatgagcgcttgtttcggcgtgggtatggtggcaggccccgtggccgggggactgttgggcgccatctccttgcatgcaccattccttgcggcggcggtgctcaacggcctcaacctactactgggctgcttcctaatgcaggagtcgcataagggagagcgtcgaatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcacatgagcgaaaaatacatcgtcacctgggacatgttgcagatccatgcacgtaaactcgcaagccgactgatgccttctgaacaatggaaaggcattattgccgtaagccgtggcggtctgtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaatcttttcaacgcctggcactgccgggcgttgttctttttaacttcaggcgggttacaatagtttccagtaagtattctggaggctgcatccatgacacaggcaaacctgagcgaaaccctgttcaaaccccgctttaaacatcctgaaacctcgacgctagtccgccgctttaatcacggcgcacaaccgcctgtgcagtcggcccttgatggtaaaaccatccctcactggtatcgcatgattaaccgtctgatgtggatctggcgcggcattgacccacgcgaaatcctcgacgtccaggcacgtattgtgatgagcgatgccgaacgtaccgacgatgatttatacgatacggtgattggctaccgtggcggcaactggatttatgagtgggccccggatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccaaaaaagaagagaaaggtagaagaccccaaggactttccttcagaattgctaagttttttgagtcatgctgtgtttagtaatagaactcttgcttgctttgctatttacaccacaaaggaaaaagctgcactgctatacaagaaaattatggaaaaatattctgtaacctttataagtaggcataacagttataatcataacatactgttttttcttactccacacaggcatagagtgtctgctattaataactatgctcaaaaattgtgtacctttagctttttaatttgtaaaggggttaataaggaatatttgatgtatagtgccttgactagagatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatcaactggataactcaagctaaccaaaatcatcccaaacttcccaccccataccctattaccactgccaattacctagtggtttcatttactctaaacctgtgattcctctgaattattttcattttaaagaaattgtatttgttaaatatgtactacaaacttagtagttggaagggctaattcactcccaaagaagacaagatatccttgatctgtggatctaccacacacaaggctacttccctgattagcagaactacacaccagggccaggggtcagatatccactgacctttggatggtgctacaagctagtaccagttgagccagataaggtagaagaggccaataaaggagagaacaccagcttgttacaccctgtgagcctgcatgggatggatgacccggagagagaagtgttagagtggaggtttgacagccgcctagcatttcatcacgtggcccgagagctgcatccggagtacttcaagaactgctgatatcgagcttgctacaagggactttccgctggggactttccagggaggcgtggcctgggcgggactggggagtggcgagccctcagatcctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgccgaattcacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccactttggctgatacgcggatctacgcgtggatccgcggcccatcacaagtttgtacaaaaaagcaggctccggatccttaaatgccgccaccatgaatttcttgctctcttgggtccactggtcccttgcactgctgctctatttgcaccacgcgaaatggtcacaagcagcgcctatggccgaagggggaggccagaaccaccatgaggttgtaaagtttatggatgtgtaccagagatcgtattgccatcctattgagacattggtcgacattttccaagaataccccgatgagatcgaatacatctttaagcccagctgtgtcccccttatgcgctgtggcgggtgttgtaatgatgagggacttgaatgtgtgcccaccgaggaaagcaatatcactatgcaaatcatgaggatcaagcctcatcagggtcaacacattggagagatgtcgttcctccagcataacaaatgtgaatgtagaccgaaaaaggaccgagctaggcaggagaatccgtgcgggccatgctccgaaagaaggaaacacctcttcgtgcaagacccccaaacgtgcaagtgtagttgcaaaaacacggattcaagatgcaaagcccggcaattggagttgaacgaacgcacatgccgttgcgacaaaccgcgtcgatgaggcgcggatccccgacccagctttc

SEQ ID NO: 72 - DNA, 9689 bp, Artificial sequence
  SEQ ID NO: 72
ttgtacaaagtggtgatgggtcaccatctagatggccatatgatcgatacgtactagtctcgacggtacctttaagaccaatgacttacaaggcagctgtagatcttagccactttttaaaagaaaaggggggactggaagggctaattcactcccaacgaagacaaaatcgtcgagagatgctgcatataagcagctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtagtagttcatgtcatcttattattcagtatttataacttgcaaagaaatgaatatcagagagtgagaggccttgacattataatagatttagcaggaattgaactaggagtggagcacacaggcaaagctgcagaagtacttggaagaagccaccagagatactcacgattctgcacatacctggctaatcccagatcctaaggattacattaagtttactaacatttatataatgatttatagtttaaagtataaacttatctaatttactattctgacagatattaattaatcctcaaatatcataagagatgattactattatccccatttaacacaagaggaaactgagagggaaagatgttgaagtaattttcccacaattacagcatccgttagttacgactctatgatcttctgacacaaattccatttactcctcaccctatgactcagtcgaatatatcaaagttatggacattatgctaagtaacaaattacccttttatatagtaaatactgagtagattgagagaagaaattgtttgcaaacctgaatagcttcaagaagaagagaagtgaggataagaataacagttgtcatttaacaagttttaacaagtaacttggttagaaagggattcaaatgcataaagcaagggataaatttttctggcaacaagactatacaatataaccttaaatatgacttcaaataattgttggaacttgataaaactaattaaatattattgaagattatcaatattataaatgtaatttacttttaaaaagggaacatagaaatgtgtatcattagagtagaaaacaatccttattatcacaatttgtcaaaacaagtttgttattaacacaagtagaatactgcattcaattaagttgactgcagattttgtgttttgttaaaattagaaagagataacaacaatttgaattattgaaagtaacatgtaaatagttctacatacgttcttttgacatcttgttcaatcattgatcgaagttctttatcttggaagaatttgttccaaagactctgaaataaggaaaacaatctattatatagtctcacacctttgttttacttttagtgatttcaatttaataatgtaaatggttaaaatttattcttctctgagatcatttcacattgcagatagaaaacctgagactggggtaatttttattaaaatctaatttaatctcagaaacacatctttattctaacatcaatttttccagtttgatattatcatataaagtcagccttcctcatctgcaggttccacaacaaaaatccaaccaactgtggatcaaaaatattgggaaaaaattaaaaatagcaatacaacaataaaaaaatacaaatcagaaaaacagcacagtataacaactttatttagcatttacaatctattaggtattataagtaatctagccagatcctctacgccggacgcatcgtggccggcatcaccggcgccacaggtgcggttgctggcgcctatatcgccgacatcaccgatggggaagatcgggctcgccacttcgggctcatgagcgcttgtttcggcgtgggtatggtggcaggccccgtggccgggggactgttgggcgccatctccttgcatgcaccattccttgcggcggcggtgctcaacggcctcaacctactactgggctgcttcctaatgcaggagtcgcataagggagagcgtcgaatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcacatgagcgaaaaatacatcgtcacctgggacatgttgcagatccatgcacgtaaactcgcaagccgactgatgccttctgaacaatggaaaggcattattgccgtaagccgtggcggtctgtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaatcttttcaacgcctggcactgccgggcgttgttctttttaacttcaggcgggttacaatagtttccagtaagtattctggaggctgcatccatgacacaggcaaacctgagcgaaaccctgttcaaaccccgctttaaacatcctgaaacctcgacgctagtccgccgctttaatcacggcgcacaaccgcctgtgcagtcggcccttgatggtaaaaccatccctcactggtatcgcatgattaaccgtctgatgtggatctggcgcggcattgacccacgcgaaatcctcgacgtccaggcacgtattgtgatgagcgatgccgaacgtaccgacgatgatttatacgatacggtgattggctaccgtggcggcaactggatttatgagtgggccccggatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccaaaaaagaagagaaaggtagaagaccccaaggactttccttcagaattgctaagttttttgagtcatgctgtgtttagtaatagaactcttgcttgctttgctatttacaccacaaaggaaaaagctgcactgctatacaagaaaattatggaaaaatattctgtaacctttataagtaggcataacagttataatcataacatactgttttttcttactccacacaggcatagagtgtctgctattaataactatgctcaaaaattgtgtacctttagctttttaatttgtaaaggggttaataaggaatatttgatgtatagtgccttgactagagatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatcaactggataactcaagctaaccaaaatcatcccaaacttcccaccccataccctattaccactgccaattacctagtggtttcatttactctaaacctgtgattcctctgaattattttcattttaaagaaattgtatttgttaaatatgtactacaaacttagtagttggaagggctaattcactcccaaagaagacaagatatccttgatctgtggatctaccacacacaaggctacttccctgattagcagaactacacaccagggccaggggtcagatatccactgacctttggatggtgctacaagctagtaccagttgagccagataaggtagaagaggccaataaaggagagaacaccagcttgttacaccctgtgagcctgcatgggatggatgacccggagagagaagtgttagagtggaggtttgacagccgcctagcatttcatcacgtggcccgagagctgcatccggagtacttcaagaactgctgatatcgagcttgctacaagggactttccgctggggactttccagggaggcgtggcctgggcgggactggggagtggcgagccctcagatcctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgccgaattcacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccactttggctgatacgcggatctacgcgtggatccgcggcccatcacaagtttgtacaaaaaagcaggctccggatccttaaatgccgccaccatgaatttcttgctctcttgggtccactggtcccttgcactgctgctctatttgcaccacgcgaaatggtcacaagcagcgcctatggccgaagggggaggccagaaccaccatgaggttgtaaagtttatggatgtgtaccagagatcgtattgccatcctattgagacattggtcgacattttccaagaataccccgatgagatcgaatacatctttaagcccagctgtgtcccccttatgcgctgtggcgggtgttgtaatgatgagggacttgaatgtgtgcccaccgaggaaagcaatatcactatgcaaatcatgaggatcaagcctcatcagggtcaacacattggagagatgtcgttcctccagcataacaaatgtgaatgtagaccgaaaaaggaccgagctaggcaggagaatccgtgcgggccatgctccgaaagaaggaaacacctcttcgtgcaagacccccaaacgtgcaagtgtagttgcaaaaacacggattcaagatgcaaagcccggcaattggagttgaacgaacgcacatgccgttcactcacacgaaaggattgaggcgcggatccccgacccagctttc

SEQ ID NO: 73 - DNA, 9557 bp, Artificial sequence
  SEQ ID NO: 73
ttgtacaaagtggtgatgggtcaccatctagatggccatatgatcgatacgtactagtctcgacggtacctttaagaccaatgacttacaaggcagctgtagatcttagccactttttaaaagaaaaggggggactggaagggctaattcactcccaacgaagacaaaatcgtcgagagatgctgcatataagcagctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtagtagttcatgtcatcttattattcagtatttataacttgcaaagaaatgaatatcagagagtgagaggccttgacattataatagatttagcaggaattgaactaggagtggagcacacaggcaaagctgcagaagtacttggaagaagccaccagagatactcacgattctgcacatacctggctaatcccagatcctaaggattacattaagtttactaacatttatataatgatttatagtttaaagtataaacttatctaatttactattctgacagatattaattaatcctcaaatatcataagagatgattactattatccccatttaacacaagaggaaactgagagggaaagatgttgaagtaattttcccacaattacagcatccgttagttacgactctatgatcttctgacacaaattccatttactcctcaccctatgactcagtcgaatatatcaaagttatggacattatgctaagtaacaaattacccttttatatagtaaatactgagtagattgagagaagaaattgtttgcaaacctgaatagcttcaagaagaagagaagtgaggataagaataacagttgtcatttaacaagttttaacaagtaacttggttagaaagggattcaaatgcataaagcaagggataaatttttctggcaacaagactatacaatataaccttaaatatgacttcaaataattgttggaacttgataaaactaattaaatattattgaagattatcaatattataaatgtaatttacttttaaaaagggaacatagaaatgtgtatcattagagtagaaaacaatccttattatcacaatttgtcaaaacaagtttgttattaacacaagtagaatactgcattcaattaagttgactgcagattttgtgttttgttaaaattagaaagagataacaacaatttgaattattgaaagtaacatgtaaatagttctacatacgttcttttgacatcttgttcaatcattgatcgaagttctttatcttggaagaatttgttccaaagactctgaaataaggaaaacaatctattatatagtctcacacctttgttttacttttagtgatttcaatttaataatgtaaatggttaaaatttattcttctctgagatcatttcacattgcagatagaaaacctgagactggggtaatttttattaaaatctaatttaatctcagaaacacatctttattctaacatcaatttttccagtttgatattatcatataaagtcagccttcctcatctgcaggttccacaacaaaaatccaaccaactgtggatcaaaaatattgggaaaaaattaaaaatagcaatacaacaataaaaaaatacaaatcagaaaaacagcacagtataacaactttatttagcatttacaatctattaggtattataagtaatctagccagatcctctacgccggacgcatcgtggccggcatcaccggcgccacaggtgcggttgctggcgcctatatcgccgacatcaccgatggggaagatcgggctcgccacttcgggctcatgagcgcttgtttcggcgtgggtatggtggcaggccccgtggccgggggactgttgggcgccatctccttgcatgcaccattccttgcggcggcggtgctcaacggcctcaacctactactgggctgcttcctaatgcaggagtcgcataagggagagcgtcgaatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcacatgagcgaaaaatacatcgtcacctgggacatgttgcagatccatgcacgtaaactcgcaagccgactgatgccttctgaacaatggaaaggcattattgccgtaagccgtggcggtctgtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaatcttttcaacgcctggcactgccgggcgttgttctttttaacttcaggcgggttacaatagtttccagtaagtattctggaggctgcatccatgacacaggcaaacctgagcgaaaccctgttcaaaccccgctttaaacatcctgaaacctcgacgctagtccgccgctttaatcacggcgcacaaccgcctgtgcagtcggcccttgatggtaaaaccatccctcactggtatcgcatgattaaccgtctgatgtggatctggcgcggcattgacccacgcgaaatcctcgacgtccaggcacgtattgtgatgagcgatgccgaacgtaccgacgatgatttatacgatacggtgattggctaccgtggcggcaactggatttatgagtgggccccggatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccaaaaaagaagagaaaggtagaagaccccaaggactttccttcagaattgctaagttttttgagtcatgctgtgtttagtaatagaactcttgcttgctttgctatttacaccacaaaggaaaaagctgcactgctatacaagaaaattatggaaaaatattctgtaacctttataagtaggcataacagttataatcataacatactgttttttcttactccacacaggcatagagtgtctgctattaataactatgctcaaaaattgtgtacctttagctttttaatttgtaaaggggttaataaggaatatttgatgtatagtgccttgactagagatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatcaactggataactcaagctaaccaaaatcatcccaaacttcccaccccataccctattaccactgccaattacctagtggtttcatttactctaaacctgtgattcctctgaattattttcattttaaagaaattgtatttgttaaatatgtactacaaacttagtagttggaagggctaattcactcccaaagaagacaagatatccttgatctgtggatctaccacacacaaggctacttccctgattagcagaactacacaccagggccaggggtcagatatccactgacctttggatggtgctacaagctagtaccagttgagccagataaggtagaagaggccaataaaggagagaacaccagcttgttacaccctgtgagcctgcatgggatggatgacccggagagagaagtgttagagtggaggtttgacagccgcctagcatttcatcacgtggcccgagagctgcatccggagtacttcaagaactgctgatatcgagcttgctacaagggactttccgctggggactttccagggaggcgtggcctgggcgggactggggagtggcgagccctcagatcctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgccgaattcacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccactttggctgatacgcggatctacgcgtggatccgcggcccatcacaagtttgtacaaaaaagcaggctccggatccttaaatgccgccaccatgaatttcttgctctcttgggtccactggtcccttgcactgctgctctatttgcaccacgcgaaatggtcacaagcagcgcctatggccgaagggggaggccagaaccaccatgaggttgtaaagtttatggatgtgtaccagagatcgtattgccatcctattgagacattggtcgacattttccaagaataccccgatgagatcgaatacatctttaagcccagctgtgtcccccttatgcgctgtggcgggtgttgtaatgatgagggacttgaatgtgtgcccaccgaggaaagcaatatcactatgcaaatcatgaggatcaagcctcatcagggtcaacacattggagagatgtcgttcctccagcataacaaatgtgaatgtagaccgaaaaaggaccgagctaggcaggagaattgcgacaaaccgcgtcgatgaggcgcggatccccgacccagctttc

SEQ ID NO: 74 - DNA, 10321 bp, Artificial sequence
  SEQ ID NO: 74
ccagatcctctacgccggacgcatcgtggccggcatcaccggcgccacaggtgcggttgctggcgcctatatcgccgacatcaccgatggggaagatcgggctcgccacttcgggctcatgagcgcttgtttcggcgtgggtatggtggcaggccccgtggccgggggactgttgggcgccatctccttgcatgcaccattccttgcggcggcggtgctcaacggcctcaacctactactgggctgcttcctaatgcaggagtcgcataagggagagcgtcgaatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcacatgagcgaaaaatacatcgtcacctgggacatgttgcagatccatgcacgtaaactcgcaagccgactgatgccttctgaacaatggaaaggcattattgccgtaagccgtggcggtctgtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaatcttttcaacgcctggcactgccgggcgttgttctttttaacttcaggcgggttacaatagtttccagtaagtattctggaggctgcatccatgacacaggcaaacctgagcgaaaccctgttcaaaccccgctttaaacatcctgaaacctcgacgctagtccgccgctttaatcacggcgcacaaccgcctgtgcagtcggcccttgatggtaaaaccatccctcactggtatcgcatgattaaccgtctgatgtggatctggcgcggcattgacccacgcgaaatcctcgacgtccaggcacgtattgtgatgagcgatgccgaacgtaccgacgatgatttatacgatacggtgattggctaccgtggcggcaactggatttatgagtgggccccggatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccaaaaaagaagagaaaggtagaagaccccaaggactttccttcagaattgctaagttttttgagtcatgctgtgtttagtaatagaactcttgcttgctttgctatttacaccacaaaggaaaaagctgcactgctatacaagaaaattatggaaaaatattctgtaacctttataagtaggcataacagttataatcataacatactgttttttcttactccacacaggcatagagtgtctgctattaataactatgctcaaaaattgtgtacctttagctttttaatttgtaaaggggttaataaggaatatttgatgtatagtgccttgactagagatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatcaactggataactcaagctaaccaaaatcatcccaaacttcccaccccataccctattaccactgccaattacctagtggtttcatttactctaaacctgtgattcctctgaattattttcattttaaagaaattgtatttgttaaatatgtactacaaacttagtagttggaagggctaattcactcccaacgaagacaagatatccttgatctgtggatctaccacacacaaggctacttccctgattagcagaactacacaccagggccagggatcagatatccactgacctttggatggtgctacaagctagtaccagttgagccagagaagttagaagaagccaacaaaggagagaacaccagcttgttacaacctgtgagcctgcatgggatggatgacccggagagagaagtgttagagtggaggtttgacagccgcctagcatttcatcacggtggcccgagagctgcatccggagtacttcaagaactgctgatatcgagcttgctacaagggactttccgctgggggactttccagggaggcgtggcctgggcgggactggggagtggcgagccctcagatcctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctagcaccgtcgacgatgtaggtcacggtctcgaagccgcggtgcgggtgccagggcgtgcccttgggctccccgggcgcgtactccacctcacccatctggtccatcatgatgaacgggtcgaggtggcggtagttgatcccggcgaacgcgcggcgcaccgggaagccctcgccctcgaaaccgctgggcgcggtggtcacggtgagcacgggacgtgcgacggcgtcggcgggtgcggatacgcggggcagcgtcagcgggttctcgacggtcacggcgggcatgtcgacgaattcacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccactttggctgatacaagtttgtacaaaaaagcaggctccggatccttaaatgccgccaccatgcccaagaagaagcgcaaggtcagcggtgccgaaaggccctatgcctgtccggtggagtcatgcgacagacgcttttcgacaaaacaaaaactcgatgtccacattcgcatccatactggacagaagccctttcagtgccggatctgtatgaggaacttctcagtggcgcacaacctcacccgccacattcggacacacacgggagagaagccgttcgcgtgcgacatttgcggacggaagtttgcgcaacatcctaatctgacaagacatacgaaaatccatcagaataagaaacagttggtcaaatccgaactggaggaaaagaaatccgagttgcggcacaaacttaagtacgtccctcacgaatacatcgaacttatcgaaatcgcccgaaattcgactcaagacagaatcttggagatgaaagtgatggaattcttcatgaaagtgtatggttatagagggaagcatttgggagggtcgcgcaaaccggatggtgcaatctacactgtgggttccccaattgactacggagtaattgtggacacgaaggcctactcaggcgggtataacctgccgattgggcaggcggatgagatgcagcggtatgtagaagagaaccagacacgaaacaagcacattaaccctaacgagtggtggaaagtgtacccatcgtcggtcaccgaattcaaattcctgtttgtaagcgggcactttaagggcaattacaaggcacaattgacacgactcaatcacattacgaattgtaatggagctgtccttagcgtggaagagctccttatcggaggagagatgatcaaagctggcaccctgacgctcgaagaagtaaggaggaaattcaataacggggagatcaacttttagtgaggcgcggatccccgacccagctttcttgtacaaagtggatccgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcatcggggtacctttaagaccaatgacttacaaggcagctgtagatcttagccactttttaaaagaaaaggggggactggaagggctaattcactcccaacgaagacaagatcgtcgagagatgctgcatataagcagctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtagtagttcatgtcatcttattattcagtatttataacttgcaaagaaatgaatatcagagagtgagaggccttgacattataatagatttagcaggaattgaactaggagtggagcacacaggcaaagctgcagaagtacttggaagaagccaccagagatactcacgattctgcacatacctggctaatcccagatcctaaggattacattaagtttactaacatttatataatgatttatagtttaaagtataaacttatctaatttactattctgacagatattaattaatcctcaaatatcataagagatgattactattatccccatttaacacaagaggaaactgagagggaaagatgttgaagtaattttcccacaattacagcatccgttagttacgactctatgatcttctgacacaaattccatttactcctcaccctatgactcagtcgaatatatcaaagttatggacattatgctaagtaacaaattacccttttatatagtaaatactgagtagattgagagaagaaattgtttgcaaacctgaatagcttcaagaagaagagaagtgaggataagaataacagttgtcatttaacaagttttaacaagtaacttggttagaaagggattcaaatgcataaagcaagggataaatttttctggcaacaagactatacaatataaccttaaatatgacttcaaataattgttggaacttgataaaactaattaaatattattgaagattatcaatattataaatgtaatttacttttaaaaagggaacatagaaatgtgtatcattagagtagaaaacaatccttattatcacaatttgtcaaaacaagtttgttattaacacaagtagaatactgcattcaattaagttgactgcagattttgtgttttgttaaaattagaaagagataacaacaatttgaattattgaaagtaacatgtaaatagttctacatacgttcttttgacatcttgttcaatcattgatcgaagttctttatcttggaagaatttgttccaaagactctgaaataaggaaaacaatctattatatagtctcacacctttgttttacttttagtgatttcaatttaataatgtaaatggttaaaatttattcttctctgagatcatttcacattgcagatagaaaacctgagactggggtaatttttattaaaatctaatttaatctcagaaacacatctttattctaacatcaatttttccagtttgatattatcatataaagtcagccttcctcatctgcaggttccacaacaaaaatccaaccaactgtggatcaaaaatattgggaaaaaattaaaaatagcaatacaacaataaaaaaatacaaatcagaaaaacagcacagtataacaactttatttagcatttacaatctattaggtattataagtaatctag

SEQ ID NO: 75 - DNA, 10322 bp, Artificial sequence
  SEQ ID NO: 75
ccagatcctctacgccggacgcatcgtggccggcatcaccggcgccacaggtgcggttgctggcgcctatatcgccgacatcaccgatggggaagatcgggctcgccacttcgggctcatgagcgcttgtttcggcgtgggtatggtggcaggccccgtggccgggggactgttgggcgccatctccttgcatgcaccattccttgcggcggcggtgctcaacggcctcaacctactactgggctgcttcctaatgcaggagtcgcataagggagagcgtcgaatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcacatgagcgaaaaatacatcgtcacctgggacatgttgcagatccatgcacgtaaactcgcaagccgactgatgccttctgaacaatggaaaggcattattgccgtaagccgtggcggtctgtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaatcttttcaacgcctggcactgccgggcgttgttctttttaacttcaggcgggttacaatagtttccagtaagtattctggaggctgcatccatgacacaggcaaacctgagcgaaaccctgttcaaaccccgctttaaacatcctgaaacctcgacgctagtccgccgctttaatcacggcgcacaaccgcctgtgcagtcggcccttgatggtaaaaccatccctcactggtatcgcatgattaaccgtctgatgtggatctggcgcggcattgacccacgcgaaatcctcgacgtccaggcacgtattgtgatgagcgatgccgaacgtaccgacgatgatttatacgatacggtgattggctaccgtggcggcaactggatttatgagtgggccccggatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccaaaaaagaagagaaaggtagaagaccccaaggactttccttcagaattgctaagttttttgagtcatgctgtgtttagtaatagaactcttgcttgctttgctatttacaccacaaaggaaaaagctgcactgctatacaagaaaattatggaaaaatattctgtaacctttataagtaggcataacagttataatcataacatactgttttttcttactccacacaggcatagagtgtctgctattaataactatgctcaaaaattgtgtacctttagctttttaatttgtaaaggggttaataaggaatatttgatgtatagtgccttgactagagatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatcaactggataactcaagctaaccaaaatcatcccaaacttcccaccccataccctattaccactgccaattacctagtggtttcatttactctaaacctgtgattcctctgaattattttcattttaaagaaattgtatttgttaaatatgtactacaaacttagtagttggaagggctaattcactcccaacgaagacaagatatccttgatctgtggatctaccacacacaaggctacttccctgattagcagaactacacaccagggccagggatcagatatccactgacctttggatggtgctacaagctagtaccagttgagccagagaagttagaagaagccaacaaaggagagaacaccagcttgttacaacctgtgagcctgcatgggatggatgacccggagagagaagtgttagagtggaggtttgacagccgcctagcatttcatcacggtggcccgagagctgcatccggagtacttcaagaactgctgatatcgagcttgctacaagggactttccgctgggggactttccagggaggcgtggcctgggcgggactggggagtggcgagccctcagatcctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctagcaccgtcgacgatgtaggtcacggtctcgaagccgcggtgcgggtgccagggcgtgcccttgggctccccgggcgcgtactccacctcacccatctggtccatcatgatgaacgggtcgaggtggcggtagttgatcccggcgaacgcgcggcgcaccgggaagccctcgccctcgaaaccgctgggcgcggtggtcacggtgagcacgggacgtgcgacggcgtcggcgggtgcggatacgcggggcagcgtcagcgggttctcgacggtcacggcgggcatgtcgacgaattcacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccactttggctgatacaagtttgtacaaaaaagcaggctccggatccttaaatgccgccaccatgcccaagaagaagcgcaaggtcagcggtgccgaaaggccctatgcctgtccggtggagtcatgcgacagacgcttttcagcgccttcgaaactcgataggcacattcgcatccatactggacagaagccctttcagtgccggatctgtatgaggaacttctccgaccggtcaaacctcacccgccacattcggacacacacgggagagaagccgttcgcgtgcgacatttgcggacggaagtttgcggaccaaggaaatctgattagacatacgaaaatccatcagaataagaaacagttggtcaaatccgaactggaggaaaagaaatccgagttgcggcacaaacttaagtacgtccctcacgaatacatcgaacttatcgaaatcgcccgaaattcgactcaagacagaatcttggagatgaaagtgatggaattcttcatgaaagtgtatggttatagagggaagcatttgggagggtcgcgcaaaccggatggtgcaatctacactgtgggttccccaattgactacggagtaattgtggacacgaaggcctactcaggcgggtataacctgccgattgggcaggcggatgagatgcagcggtatgtagaagagaaccagacacgaaacaagcacattaaccctaacgagtggtggaaagtgtacccatcgtcggtcaccgaattcaaattcctgtttgtaagcgggcactttaagggcaattacaaggcacaattgacacgactcaatcacattacgaattgtaatggagctgtccttagcgtggaagagctccttatcggaggagagatgatcaaagctggcaccctgacgctcgaagaagtaaggaggaaattcaataacggggagatcaacttttagtgaggcgcggatccccgacccagctttcttgtacaaagtgggatccgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcatcggggtacctttaagaccaatgacttacaaggcagctgtagatcttagccactttttaaaagaaaaggggggactggaagggctaattcactcccaacgaagacaagatcgtcgagagatgctgcatataagcagctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtagtagttcatgtcatcttattattcagtatttataacttgcaaagaaatgaatatcagagagtgagaggccttgacattataatagatttagcaggaattgaactaggagtggagcacacaggcaaagctgcagaagtacttggaagaagccaccagagatactcacgattctgcacatacctggctaatcccagatcctaaggattacattaagtttactaacatttatataatgatttatagtttaaagtataaacttatctaatttactattctgacagatattaattaatcctcaaatatcataagagatgattactattatccccatttaacacaagaggaaactgagagggaaagatgttgaagtaattttcccacaattacagcatccgttagttacgactctatgatcttctgacacaaattccatttactcctcaccctatgactcagtcgaatatatcaaagttatggacattatgctaagtaacaaattacccttttatatagtaaatactgagtagattgagagaagaaattgtttgcaaacctgaatagcttcaagaagaagagaagtgaggataagaataacagttgtcatttaacaagttttaacaagtaacttggttagaaagggattcaaatgcataaagcaagggataaatttttctggcaacaagactatacaatataaccttaaatatgacttcaaataattgttggaacttgataaaactaattaaatattattgaagattatcaatattataaatgtaatttacttttaaaaagggaacatagaaatgtgtatcattagagtagaaaacaatccttattatcacaatttgtcaaaacaagtttgttattaacacaagtagaatactgcattcaattaagttgactgcagattttgtgttttgttaaaattagaaagagataacaacaatttgaattattgaaagtaacatgtaaatagttctacatacgttcttttgacatcttgttcaatcattgatcgaagttctttatcttggaagaatttgttccaaagactctgaaataaggaaaacaatctattatatagtctcacacctttgttttacttttagtgatttcaatttaataatgtaaatggttaaaatttattcttctctgagatcatttcacattgcagatagaaaacctgagactggggtaatttttattaaaatctaatttaatctcagaaacacatctttattctaacatcaatttttccagtttgatattatcatataaagtcagccttcctcatctgcaggttccacaacaaaaatccaaccaactgtggatcaaaaatattgggaaaaaattaaaaatagcaatacaacaataaaaaaatacaaatcagaaaaacagcacagtataacaactttatttagcatttacaatctattaggtattataagtaatctag

SEQ ID NO: 76 - DNA, 29 bp, Artificial sequence
  SEQ ID NO: 76
gcgaccatcttcttcaagacgacggcaac

SEQ ID NO: 77 - DNA, 29 bp, Artificial sequence
  SEQ ID NO: 77
gcgaccatcttctcaaggacgacggcaac

SEQ ID NO: 78 - DNA, 32 bp, Artificial sequence
  SEQ ID NO: 78
gcgaccatcttcttctcaaggacgacggcaac

SEQ ID NO: 79 - DNA, 29 bp, Artificial sequence
  SEQ ID NO: 79
gcgaccatcttcttcaggacgacggcaac

SEQ ID NO: 80 - DNA, 10412 bp, Artificial sequence
  SEQ ID NO: 80
ttgtacaaagtggtgatgatccgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcatcggggtacctttaagaccaatgacttacaaggcagctgtagatcttagccactttttaaaagaaaaggggggactggaagggctaattcactcccaacgaagacaagatcgtcgagagatgctgcatataagcagctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtagtagttcatgtcatcttattattcagtatttataacttgcaaagaaatgaatatcagagagtgagaggccttgacattataatagatttagcaggaattgaactaggagtggagcacacaggcaaagctgcagaagtacttggaagaagccaccagagatactcacgattctgcacatacctggctaatcccagatcctaaggattacattaagtttactaacatttatataatgatttatagtttaaagtataaacttatctaatttactattctgacagatattaattaatcctcaaatatcataagagatgattactattatccccatttaacacaagaggaaactgagagggaaagatgttgaagtaattttcccacaattacagcatccgttagttacgactctatgatcttctgacacaaattccatttactcctcaccctatgactcagtcgaatatatcaaagttatggacattatgctaagtaacaaattacccttttatatagtaaatactgagtagattgagagaagaaattgtttgcaaacctgaatagcttcaagaagaagagaagtgaggataagaataacagttgtcatttaacaagttttaacaagtaacttggttagaaagggattcaaatgcataaagcaagggataaatttttctggcaacaagactatacaatataaccttaaatatgacttcaaataattgttggaacttgataaaactaattaaatattattgaagattatcaatattataaatgtaatttacttttaaaaagggaacatagaaatgtgtatcattagagtagaaaacaatccttattatcacaatttgtcaaaacaagtttgttattaacacaagtagaatactgcattcaattaagttgactgcagattttgtgttttgttaaaattagaaagagataacaacaatttgaattattgaaagtaacatgtaaatagttctacatacgttcttttgacatcttgttcaatcattgatcgaagttctttatcttggaagaatttgttccaaagactctgaaataaggaaaacaatctattatatagtctcacacctttgttttacttttagtgatttcaatttaataatgtaaatggttaaaatttattcttctctgagatcatttcacattgcagatagaaaacctgagactggggtaatttttattaaaatctaatttaatctcagaaacacatctttattctaacatcaatttttccagtttgatattatcatataaagtcagccttcctcatctgcaggttccacaacaaaaatccaaccaactgtggatcaaaaatattgggaaaaaattaaaaatagcaatacaacaataaaaaaatacaaatcagaaaaacagcacagtataacaactttatttagcatttacaatctattaggtattataagtaatctagccagatcctctacgccggacgcatcgtggccggcatcaccggcgccacaggtgcggttgctggcgcctatatcgccgacatcaccgatggggaagatcgggctcgccacttcgggctcatgagcgcttgtttcggcgtgggtatggtggcaggccccgtggccgggggactgttgggcgccatctccttgcatgcaccattccttgcggcggcggtgctcaacggcctcaacctactactgggctgcttcctaatgcaggagtcgcataagggagagcgtcgaatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcacatgagcgaaaaatacatcgtcacctgggacatgttgcagatccatgcacgtaaactcgcaagccgactgatgccttctgaacaatggaaaggcattattgccgtaagccgtggcggtctgtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaatcttttcaacgcctggcactgccgggcgttgttctttttaacttcaggcgggttacaatagtttccagtaagtattctggaggctgcatccatgacacaggcaaacctgagcgaaaccctgttcaaaccccgctttaaacatcctgaaacctcgacgctagtccgccgctttaatcacggcgcacaaccgcctgtgcagtcggcccttgatggtaaaaccatccctcactggtatcgcatgattaaccgtctgatgtggatctggcgcggcattgacccacgcgaaatcctcgacgtccaggcacgtattgtgatgagcgatgccgaacgtaccgacgatgatttatacgatacggtgattggctaccgtggcggcaactggatttatgagtgggccccggatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccaaaaaagaagagaaaggtagaagaccccaaggactttccttcagaattgctaagttttttgagtcatgctgtgtttagtaatagaactcttgcttgctttgctatttacaccacaaaggaaaaagctgcactgctatacaagaaaattatggaaaaatattctgtaacctttataagtaggcataacagttataatcataacatactgttttttcttactccacacaggcatagagtgtctgctattaataactatgctcaaaaattgtgtacctttagctttttaatttgtaaaggggttaataaggaatatttgatgtatagtgccttgactagagatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatcaactggataactcaagctaaccaaaatcatcccaaacttcccaccccataccctattaccactgccaattacctagtggtttcatttactctaaacctgtgattcctctgaattattttcattttaaagaaattgtatttgttaaatatgtactacaaacttagtagttggaagggctaattcactcccaacgaagacaagatatccttgatctgtggatctaccacacacaaggctacttccctgattagcagaactacacaccagggccagggatcagatatccactgacctttggatggtgctacaagctagtaccagttgagccagagaagttagaagaagccaacaaaggagagaacaccagcttgttacaacctgtgagcctgcatgggatggatgacccggagagagaagtgttagagtggaggtttgacagccgcctagcatttcatcacggtggcccgagagctgcatccggagtacttcaagaactgctgatatcgagcttgctacaagggactttccgctgggggactttccagggaggcgtggcctgggcgggactggggagtggcgagccctcagatcctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctagcaccgtcgacgatgtaggtcacggtctcgaagccgcggtgcgggtgccagggcgtgcccttgggctccccgggcgcgtactccacctcacccatctggtccatcatgatgaacgggtcgaggtggcggtagttgatcccggcgaacgcgcggcgcaccgggaagccctcgccctcgaaaccgctgggcgcggtggtcacggtgagcacgggacgtgcgacggcgtcggcgggtgcggatacgcggggcagcgtcagcgggttctcgacggtcacggcgggcatgtcgacgaattcacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccactttggctgatacgcgatcacaagtttgtacaaaaaagcaggctccttaaaactagttgccgccaccatggcccccaagaaaaagcggaaagtcgcagaagaaagaccttttcagtgtaggatctgtatgaggaactttagccgatcctcgaacctgatcgtgcatattcggacacatactggagagaaaccgtttgcatgcgacatttgcggaaggaaattcgcgcaaaacgcgaatcggaatacgcacaccaagatccatacagggtcagagaggccgtttcagtgtcgaatctgcatgcgcaatttctcccggagcagcgcgctctcacggcacatccggacccatacaggcgagaagccgttcgcgtgtgacatttgtggtcgcaaattcgctaattcatcaaatcgcaccgtccatacgaagatccaccagaacaagaagcagcttgtgaaatccgaattggaggagaaaaagtcggaactccgccacaagttgaagtacgtaccacacgaatacattgagctgatcgagattgcgagaaattcgacacaagatagaatcttggagatgaaggtaatggaattctttatgaaggtctatggctatagagggaaacacctcggaggatcgagaaagcccgacggggccatctacactgtcgggtcgccaatcgactatggagtcatcgtggatacaaaggcctattcgggaggttacaacctccccattggacaggcagatgagatgcagcgatatgtaaaggagaaccaaacccgaaacaagcacattaaccccaacgagtggtggaaagtgtacccttcatcggtaacggagtttaagtttctgtttgtgtcggggcatttcaaaggtaactacaaggcgcagcttactagacttaaccacaaaacgaactgcaacggagcggtgttgtccgtggaagagctcctgatcgggggtgaaatgatcaaggccggcacgcttacgttggaagaagtcaggcgcaaattcaataacggggagatcaatttctaaggcgcctcgagccgacccagctttc

SEQ ID NO: 81 - DNA, 10412 bp, Artificial sequence
  SEQ ID NO: 81
ttgtacaaagtggtgatgatccgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcatcggggtacctttaagaccaatgacttacaaggcagctgtagatcttagccactttttaaaagaaaaggggggactggaagggctaattcactcccaacgaagacaagatcgtcgagagatgctgcatataagcagctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtagtagttcatgtcatcttattattcagtatttataacttgcaaagaaatgaatatcagagagtgagaggccttgacattataatagatttagcaggaattgaactaggagtggagcacacaggcaaagctgcagaagtacttggaagaagccaccagagatactcacgattctgcacatacctggctaatcccagatcctaaggattacattaagtttactaacatttatataatgatttatagtttaaagtataaacttatctaatttactattctgacagatattaattaatcctcaaatatcataagagatgattactattatccccatttaacacaagaggaaactgagagggaaagatgttgaagtaattttcccacaattacagcatccgttagttacgactctatgatcttctgacacaaattccatttactcctcaccctatgactcagtcgaatatatcaaagttatggacattatgctaagtaacaaattacccttttatatagtaaatactgagtagattgagagaagaaattgtttgcaaacctgaatagcttcaagaagaagagaagtgaggataagaataacagttgtcatttaacaagttttaacaagtaacttggttagaaagggattcaaatgcataaagcaagggataaatttttctggcaacaagactatacaatataaccttaaatatgacttcaaataattgttggaacttgataaaactaattaaatattattgaagattatcaatattataaatgtaatttacttttaaaaagggaacatagaaatgtgtatcattagagtagaaaacaatccttattatcacaatttgtcaaaacaagtttgttattaacacaagtagaatactgcattcaattaagttgactgcagattttgtgttttgttaaaattagaaagagataacaacaatttgaattattgaaagtaacatgtaaatagttctacatacgttcttttgacatcttgttcaatcattgatcgaagttctttatcttggaagaatttgttccaaagactctgaaataaggaaaacaatctattatatagtctcacacctttgttttacttttagtgatttcaatttaataatgtaaatggttaaaatttattcttctctgagatcatttcacattgcagatagaaaacctgagactggggtaatttttattaaaatctaatttaatctcagaaacacatctttattctaacatcaatttttccagtttgatattatcatataaagtcagccttcctcatctgcaggttccacaacaaaaatccaaccaactgtggatcaaaaatattgggaaaaaattaaaaatagcaatacaacaataaaaaaatacaaatcagaaaaacagcacagtataacaactttatttagcatttacaatctattaggtattataagtaatctagccagatcctctacgccggacgcatcgtggccggcatcaccggcgccacaggtgcggttgctggcgcctatatcgccgacatcaccgatggggaagatcgggctcgccacttcgggctcatgagcgcttgtttcggcgtgggtatggtggcaggccccgtggccgggggactgttgggcgccatctccttgcatgcaccattccttgcggcggcggtgctcaacggcctcaacctactactgggctgcttcctaatgcaggagtcgcataagggagagcgtcgaatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcacatgagcgaaaaatacatcgtcacctgggacatgttgcagatccatgcacgtaaactcgcaagccgactgatgccttctgaacaatggaaaggcattattgccgtaagccgtggcggtctgtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaatcttttcaacgcctggcactgccgggcgttgttctttttaacttcaggcgggttacaatagtttccagtaagtattctggaggctgcatccatgacacaggcaaacctgagcgaaaccctgttcaaaccccgctttaaacatcctgaaacctcgacgctagtccgccgctttaatcacggcgcacaaccgcctgtgcagtcggcccttgatggtaaaaccatccctcactggtatcgcatgattaaccgtctgatgtggatctggcgcggcattgacccacgcgaaatcctcgacgtccaggcacgtattgtgatgagcgatgccgaacgtaccgacgatgatttatacgatacggtgattggctaccgtggcggcaactggatttatgagtgggccccggatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccaaaaaagaagagaaaggtagaagaccccaaggactttccttcagaattgctaagttttttgagtcatgctgtgtttagtaatagaactcttgcttgctttgctatttacaccacaaaggaaaaagctgcactgctatacaagaaaattatggaaaaatattctgtaacctttataagtaggcataacagttataatcataacatactgttttttcttactccacacaggcatagagtgtctgctattaataactatgctcaaaaattgtgtacctttagctttttaatttgtaaaggggttaataaggaatatttgatgtatagtgccttgactagagatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatcaactggataactcaagctaaccaaaatcatcccaaacttcccaccccataccctattaccactgccaattacctagtggtttcatttactctaaacctgtgattcctctgaattattttcattttaaagaaattgtatttgttaaatatgtactacaaacttagtagttggaagggctaattcactcccaacgaagacaagatatccttgatctgtggatctaccacacacaaggctacttccctgattagcagaactacacaccagggccagggatcagatatccactgacctttggatggtgctacaagctagtaccagttgagccagagaagttagaagaagccaacaaaggagagaacaccagcttgttacaacctgtgagcctgcatgggatggatgacccggagagagaagtgttagagtggaggtttgacagccgcctagcatttcatcacggtggcccgagagctgcatccggagtacttcaagaactgctgatatcgagcttgctacaagggactttccgctgggggactttccagggaggcgtggcctgggcgggactggggagtggcgagccctcagatcctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctagcaccgtcgacgatgtaggtcacggtctcgaagccgcggtgcgggtgccagggcgtgcccttgggctccccgggcgcgtactccacctcacccatctggtccatcatgatgaacgggtcgaggtggcggtagttgatcccggcgaacgcgcggcgcaccgggaagccctcgccctcgaaaccgctgggcgcggtggtcacggtgagcacgggacgtgcgacggcgtcggcgggtgcggatacgcggggcagcgtcagcgggttctcgacggtcacggcgggcatgtcgacgaattcacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccactttggctgatacgcgatcacaagtttgtacaaaaaagcaggctccttaaaactagttgccgccaccatggccccaaagaagaagcggaaggtagctgaggagaggccgtttcagtgccgcatctgtatgcgcaatttctcaaggtcggataccttgtcaaggcacattcgaacgcataccggtgagaaacccttcgcctgtgatatctgtggccgcaagtttgcaaggaaggacgcgcggatcaaccacaccaaaatccacacagggtccgagcgcccctttcagtgcagaatctgcatgagaaacttttcgagaagctcacacctctccacgcacattaggacgcacacgggggagaaaccgttcgcttgcgacatctgtggtagaaagtttgcgaagtcagacaaccgaacgacacatactaagatccatcaaaacaaaaagcagctggtcaagtcggagttggaagagaaaaagtcggagctgcgacataaacttaagtacgtccctcatgaatacatcgaattgatcgagattgcgcggaacagcactcaagatagaattcttgagatgaaagtgatggaattctttatgaaagtatacggatacaggggaaagcacctcggaggttcgcggaaaccggacggagcaatctacacggtagggtcccccattgactatggggtcatcgtggataccaaggcatacagcggtggctacaatcttcctatcgggcaggcggatgagatggaacgctatgtggaagaaaatcaaactagaaacaaacacctcaatcccaatgagtggtggaaagtctatccctcatcggtcactgaattcaagtttctcttcgtgagcggacatttcaaagggaactataaggcgcagcttacacgcttgaaccacattacaaattgcaatggagccgtgctgtcggtggaggagttgcttatcggaggggaaatgattaaggccggaacactgacattggaggaagtccggcggaagttcaacaatggcgaaatcaatttctaaggcgcctcgagccgacccagctttc

SEQ ID NO: 82 - DNA, 1320 bp, Artificial sequence
  DNA polymerase region HIV-1 reverse transctiptase
cccattagtcctattgagactgtaccagtaaaattaaagccaggaatggatggcccaaaagttaaacaatggccattgacagaagaaaaaataaaagcattagtagaaatttgtacagaaatggaaaaggaaggaaaaatttcaaaaattgggcctgaaaatccatacaatactccagtatttgccataaagaaaaaagacagtactaaatggagaaaattagtagatttcagagaacttaataagagaactcaagatttctgggaagttcaattaggaataccacatcctgcagggttaaaacagaaaaaatcagtaacagtactggaggtgggcgatgcatatttttcagttcccttagataaagacttcaggaagtatactgcatttaccatacctagtataaacaatgagacaccagggattagatatcagtacaatgtgcttccacagggatggaaaggatcaccagcaatattccagtgtagcatgacaaaaatcttagagccttttagaaaacaaaatccagacatagtcatctatcaatacatggatgatttgtatgtaggatctgacttagaaatagggcagcatagaacaaaaatagaggaactgagacaacatctgttgaggtggggatttaccacaccagacaaaaaacatcagaaagaacctccattcctttggatgggttatgaactccatcctgataaatggacagtacagcctatagtgctgccagaaaaggacagctggactgtcaatgacatacagaaattagtgggaaaattgaattgggcaagtcagatttatgcagggattaaagtaaggcaattatgtaaacttcttaggggaaccaaagcactaacagaagtagtaccactaacagaagaagcagagctagaactggcagaaaacagggagattctaaaagaaccggtacatggagtgtattatgacccatcaaaagacttaatagcagaaatacagaagcaggggcaaggccaatggacatatcaaatttatcaagagccatttaaaaatctgaaaacaggaaagtatgcaagaatgaagggtgcccacactaatgatgtgaaacaattaacagaggcagtacaaaaaatagccacagaaagcatagtaatatggggaaagactcctaaatttaaattacccatacaaaaggaaacatgggaagcatggtggacagagtattggcaagccacctggattcctgagtgggagtttgtcaatacccctcccttagtgaagttatggtaccagttagagaaagaacccataataggagcagaaactttc

SEQ ID NO: 83 - DNA, 360 bp, Artificial sequence
  DNA RNaseH region HIV-1 reverse transctiptase
tatgtagatggggcagccaatagggaaactaaattaggaaaagcaggatatgtaactgacagaggaagacaaaaagttgtccccctaacggacacaacaaatcagaagactgagttacaagcaattcatctagctttgcaggattcgggattagaagtaaacatagtgacagactcacaatatgcattgggaatcattcaagcacaaccagataagagtgaatcagagttagtcagtcaaataatagagcagttaataaaaaaggaaaaagtctacctggcatgggtaccagcacacaaaggaattggaggaaatgaacaagtagataaattggtcagtgctggaatcaggaaagtacta

SEQ ID NO: 84 - protein, 560 aa, Human immunodeficiency virus 1
  MISC_FEATURE (23)..(23): Xaa can be any naturally occuring amino acid except Q
  MISC_FEATURE (24)..(24): Xaa can be any naturally occuring amino acid except W
  MISC_FEATURE (25)..(25): Xaa can be any naturally occuring amino acid except L or P
  MISC_FEATURE (45)..(45): Xaa can be any naturally occuring amino acid except G
  MISC_FEATURE (52)..(52): Xaa can be any naturally occuring amino acid except D, G, N, P or S
  MISC_FEATURE (53)..(53): Xaa can be any naturally occuring amino acid except A, D, E, G, H, K, N, Q, R, S or T
  MISC_FEATURE (54)..(54): Xaa can be any naturally occuring amino acid except D, G, K, N or S
  MISC_FEATURE (55)..(55): Xaa can be any naturally occuring amino acid except N, P or T
  MISC_FEATURE (57)..(57): Xaa can be any naturally occuring amino acid except N or S
  MISC_FEATURE (59)..(59): Xaa can be any naturally occuring amino acid except P
  MISC_FEATURE (60)..(60): Xaa can be any naturally occuring amino acid except I, L, T or V
  MISC_FEATURE (61)..(61): Xaa can be any naturally occuring amino acid except F
  MISC_FEATURE (65)..(65): Xaa can be any naturally occuring amino acid except K
  MISC_FEATURE (72)..(72): Xaa can be any naturally occuring amino acid except I or R
  MISC_FEATURE (74)..(74): Xaa can be any naturally occuring amino acid except L
  MISC_FEATURE (76)..(76): Xaa can be any naturally occuring amino acid except D or N
  MISC_FEATURE (77)..(77): Xaa can be any naturally occuring amino acid except F or L
  MISC_FEATURE (78)..(78): Xaa can be any naturally occuring amino acid except R
  MISC_FEATURE (81)..(81): Xaa can be any naturally occuring amino acid except N
  MISC_FEATURE (110)..(110): Xaa can be any naturally occuring amino acid except D
  MISC_FEATURE (111)..(111): Xaa can be any naturally occuring amino acid except I or V
  MISC_FEATURE (113)..(113): Xaa can be any naturally occuring amino acid except D or G
  MISC_FEATURE (114)..(114): Xaa can be any naturally occuring amino acid except A
  MISC_FEATURE (115)..(115): Xaa can be any naturally occuring amino acid except Y
  MISC_FEATURE (130)..(130): Xaa can be any naturally occuring amino acid except F or S
  MISC_FEATURE (134)..(134): Xaa can be any naturally occuring amino acid except A, R, S or T
  MISC_FEATURE (135)..(135): Xaa can be any naturally occuring amino acid except A, I, L, P, T or V
  MISC_FEATURE (136)..(136): Xaa can be any naturally occuring amino acid except N
  MISC_FEATURE (137)..(137): Xaa can be any naturally occuring amino acid except H or N
  MISC_FEATURE (138)..(138): Xaa can be any naturally occuring amino acid except A, C, D, E, G, H, K, N, Q, R, S or T
  MISC_FEATURE (139)..(139): Xaa can be any naturally occuring amino acid except A, C, D, E, G, I, K, L, M, N, P, Q, R, S,T or V
  MISC_FEATURE (140)..(140): Xaa can be any naturally occuring amino acid except P
  MISC_FEATURE (149)..(149): Xaa can be any naturally occuring amino acid except L
  MISC_FEATURE (150)..(150): Xaa can be any naturally occuring amino acid except P
  MISC_FEATURE (151)..(151): Xaa can be any naturally occuring amino acid except Q
  MISC_FEATURE (152)..(152): Xaa can be any naturally occuring amino acid except G
  MISC_FEATURE (154)..(154): Xaa can be any naturally occuring amino acid except A, K, R or T
  MISC_FEATURE (156)..(156): Xaa can be any naturally occuring amino acid except S
  MISC_FEATURE (157)..(157): Xaa can be any naturally occuring amino acid except P
  MISC_FEATURE (181)..(181): Xaa can be any naturally occuring amino acid except C, F, H, I, L, M, V or Y
  MISC_FEATURE (183)..(183): Xaa can be any naturally occuring amino acid except Y
  MISC_FEATURE (184)..(184): Xaa can be any naturally occuring amino acid except I or M
  MISC_FEATURE (185)..(185): Xaa can be any naturally occuring amino acid except D
  MISC_FEATURE (186)..(186): Xaa can be any naturally occuring amino acid except D
  MISC_FEATURE (188)..(188): Xaa can be any naturally occuring amino acid except F, L, W or Y
  MISC_FEATURE (190)..(190): Xaa can be any naturally occuring amino acid except A or G
  MISC_FEATURE (229)..(229): Xaa can be any naturally occuring amino acid except W
  MISC_FEATURE (230)..(230): Xaa can be any naturally occuring amino acid except L or M
  MISC_FEATURE (231)..(231): Xaa can be any naturally occuring amino acid except G
  MISC_FEATURE (232)..(232): Xaa can be any naturally occuring amino acid except F or Y
  MISC_FEATURE (255)..(255): Xaa can be any naturally occuring amino acid except N
  MISC_FEATURE (256)..(256): Xaa can be any naturally occuring amino acid except A, D, E or K
  MISC_FEATURE (257)..(257): Xaa can be any naturally occuring amino acid except I, L or V
  MISC_FEATURE (258)..(258): Xaa can be any naturally occuring amino acid except Q
  MISC_FEATURE (259)..(259): Xaa can be any naturally occuring amino acid except K or N
  MISC_FEATURE (260)..(260): Xaa can be any naturally occuring amino acid except L
  MISC_FEATURE (261)..(261): Xaa can be any naturally occuring amino acid except A, I, M or V
  MISC_FEATURE (262)..(262): Xaa can be any naturally occuring amino acid except E or G
  MISC_FEATURE (263)..(263): Xaa can be any naturally occuring amino acid except A, D, E, G, H, K, N, P, Q, R, S, T or V
  MISC_FEATURE (264)..(264): Xaa can be any naturally occuring amino acid except I or L
  MISC_FEATURE (265)..(265): Xaa can be any naturally occuring amino acid except A, N, S or T
  MISC_FEATURE (266)..(266): Xaa can be any naturally occuring amino acid except W
  MISC_FEATURE (280)..(280): Xaa can be any naturally occuring amino acid except A, C, L, T or V
  MISC_FEATURE (281)..(281): Xaa can be any naturally occuring amino acid except A, K, N, Q or R
  MISC_FEATURE (282)..(282): Xaa can be any naturally occuring amino acid except L, M or T
  MISC_FEATURE (283)..(283): Xaa can be any naturally occuring amino acid except I, L, M, T or V
  MISC_FEATURE (284)..(284): Xaa can be any naturally occuring amino acid except E, K or R
  MISC_FEATURE (285)..(285): Xaa can be any naturally occuring amino acid except G
  MISC_FEATURE (286)..(286): Xaa can be any naturally occuring amino acid except A, C, D, E, G, H, I, K, L, M, N, P, Q, R, S, T or V
  MISC_FEATURE (287)..(287): Xaa can be any naturally occuring amino acid except A, E, G, H, K, N, P, Q, R, S or T
  MISC_FEATURE (288)..(288): Xaa can be any naturally occuring amino acid except A, D, E, G, H, I, K, L, N, Q, R, S, T, or V
  MISC_FEATURE (289)..(289): Xaa can be any naturally occuring amino acid except I or L
  MISC_FEATURE (290)..(290): Xaa can be any naturally occuring amino acid except A, D, E, G, H, K, L, N, P, Q, R, S, T or V
  MISC_FEATURE (302)..(302): Xaa can be any naturally occuring amino acid except E
  MISC_FEATURE (318)..(318): Xaa can be any naturally occuring amino acid except F or Y
  MISC_FEATURE (351)..(351): Xaa can be any naturally occuring amino acid except A, G, K, L, P, S, T or V
  MISC_FEATURE (353)..(353): Xaa can be any naturally occuring amino acid except K or R
  MISC_FEATURE (355)..(355): Xaa can be any naturally occuring amino acid except A, C, D, E, G, H, I, K, L, M, N, Q, R, S, T or V
  MISC_FEATURE (359)..(359): Xaa can be any naturally occuring amino acid except A, D, E, G, K, N, Q, R, S or T
  MISC_FEATURE (374)..(374): Xaa can be any naturally occuring amino acid except H, K or R
  MISC_FEATURE (375)..(375): Xaa can be any naturally occuring amino acid except I, L or V
  MISC_FEATURE (378)..(378): Xaa can be any naturally occuring amino acid except E
  MISC_FEATURE (384)..(384): Xaa can be any naturally occuring amino acid except G
  MISC_FEATURE (391)..(391): Xaa can be any naturally occuring amino acid except I, L or V
  MISC_FEATURE (393)..(393): Xaa can be any naturally occuring amino acid except A, F, I, L, M, T, V or Y
  MISC_FEATURE (394)..(394): Xaa can be any naturally occuring amino acid except A, D, E, G, K, L, N, P, Q, R, S or T
  MISC_FEATURE (395)..(395): Xaa can be any naturally occuring amino acid except E, K or R
  MISC_FEATURE (396)..(396): Xaa can be any naturally occuring amino acid except D or E
  MISC_FEATURE (397)..(397): Xaa can be any naturally occuring amino acid except A, C, D, E, G, I, K, L, M, N, P, Q, R, S, T or V
  MISC_FEATURE (398)..(398): Xaa can be any naturally occuring amino acid except F, V, W or Y
  MISC_FEATURE (399)..(399): Xaa can be any naturally occuring amino acid except D, E, G, R or S
  MISC_FEATURE (400)..(400): Xaa can be any naturally occuring amino acid except A, C, D, E, G, H, I, K, L, M, N, Q, R, S, T or V
  MISC_FEATURE (401)..(401): Xaa can be any naturally occuring amino acid except A, F, I, L, M, R, V, W or Y
  MISC_FEATURE (402)..(402): Xaa can be any naturally occuring amino acid except A, F, I, L, M, V or W
  MISC_FEATURE (406)..(406): Xaa can be any naturally occuring amino acid except A, D, L, R, T, V or W
  MISC_FEATURE (410)..(410): Xaa can be any naturally occuring amino acid except A or W
  MISC_FEATURE (412)..(412): Xaa can be any naturally occuring amino acid except P
  MISC_FEATURE (414)..(414): Xaa can be any naturally occuring amino acid except A, F, I, L, M, V, W or Y
  MISC_FEATURE (420)..(420): Xaa can be any naturally occuring amino acid except G, P, S or T
  MISC_FEATURE (421)..(421): Xaa can be any naturally occuring amino acid except H, K, P, Q, R or T
  MISC_FEATURE (422)..(422): Xaa can be any naturally occuring amino acid except A, C, F, I, L, T, V or Y
  MISC_FEATURE (423)..(423): Xaa can be any naturally occuring amino acid except A, F, I, L, M, T, V or Y
  MISC_FEATURE (440)..(440): Xaa can be any naturally occuring amino acid except F, I, W or Y
  MISC_FEATURE (441)..(441): Xaa can be any naturally occuring amino acid except Y
  MISC_FEATURE (443)..(443): Xaa can be any naturally occuring amino acid except D
  MISC_FEATURE (448)..(448): Xaa can be any naturally occuring amino acid except K or R
  MISC_FEATURE (451)..(451): Xaa can be any naturally occuring amino acid except G, K, Q or R
  MISC_FEATURE (473)..(473): Xaa can be any naturally occuring amino acid except S or T
  MISC_FEATURE (474)..(474): Xaa can be any naturally occuring amino acid except H or N
  MISC_FEATURE (475)..(475): Xaa can be any naturally occuring amino acid except Q
  MISC_FEATURE (476)..(476): Xaa can be any naturally occuring amino acid except E, K, Q or R
  MISC_FEATURE (478)..(478): Xaa can be any naturally occuring amino acid except E
  MISC_FEATURE (481)..(481): Xaa can be any naturally occuring amino acid except A
  MISC_FEATURE (485)..(485): Xaa can be any naturally occuring amino acid except A
  MISC_FEATURE (495)..(495): Xaa can be any naturally occuring amino acid except I or L
  MISC_FEATURE (498)..(498): Xaa can be any naturally occuring amino acid except D
  MISC_FEATURE (499)..(499): Xaa can be any naturally occuring amino acid except S
  MISC_FEATURE (500)..(500): Xaa can be any naturally occuring amino acid except K, Q or R
  MISC_FEATURE (501)..(501): Xaa can be any naturally occuring amino acid except Y
  MISC_FEATURE (539)..(539): Xaa can be any naturally occuring amino acid except H
  MISC_FEATURE (549)..(549): Xaa can be any naturally occuring amino acid except D
PISPIETVPVKLKPGMDGPKVKXXXLTEEKIKALVEICTEMEKEXKISKIGXXXXYXTXXXAIKXKDSTKWXKXVXXXELXKRTQDFWEVQLGIPHPAGLKQKKSVTVLXXGXXXFSVPLDKDFRKYTAXTIPXXXXXXXGIRYQYNVXXXXWXGXXAIFQCSMTKILEPFRKQNPDIVIXQXXXXLXVXSDLEIGQHRTKIEELRQHLLRWGFTTPDKKHQKEPPFLXXXXELHPDKWTVQPIVLPEKDSWTVXXXXXXXXXXXXASQIYAGIKVRQLXXXXXXXXXXXEVVPLTEEAELXLAENREILKEPVHGVXYDPSKDLIAEIQKQGQGQWTYQIYQEPFKNLKXGXYXRMKXAHTNDVKQLTEAVQXXATXSIVIWXKTPKFKXPXXXXXXXXXXTEYXQATXIXEXEFVNTXXXXKLWYQLEKEPIIGAETXXVXGAANXETXLGKAGYVTDRGRQKVVPLTDTXXXXTXLQXIHLXLQDSGLEVNXVTXXXXALGIIQAQPDKSESELVSQIIEQLIKKEKVYLAWVPAXKGIGGNEQVXGLVSAGIRKVL

SEQ ID NO: 85 - protein, 671 aa, Moloney murine sarcoma virus
  MISC_FEATURE (63)..(63): Xaa can be any naturally occuring amino acid except Q
  MISC_FEATURE (65)..(65): Xaa can be any naturally occuring amino acid except P or W
  MISC_FEATURE (85)..(85): Xaa can be any naturally occuring amino acid except G or P
  MISC_FEATURE (95)..(95): Xaa can be any naturally occuring amino acid except G or N
  MISC_FEATURE (97)..(97): Xaa can be any naturally occuring amino acid except L or P
  MISC_FEATURE (103)..(103): Xaa can be any naturally occuring amino acid except K or P
  MISC_FEATURE (110)..(110): Xaa can be any naturally occuring amino acid except R
  MISC_FEATURE (114)..(114): Xaa can be any naturally occuring amino acid except D or F
  MISC_FEATURE (116)..(116): Xaa can be any naturally occuring amino acid except K or R
  MISC_FEATURE (119)..(119): Xaa can be any naturally occuring amino acid except N or R
  MISC_FEATURE (150)..(150): Xaa can be any naturally occuring amino acid except D
  MISC_FEATURE (152)..(152): Xaa can be any naturally occuring amino acid except D or K
  MISC_FEATURE (153)..(153): Xaa can be any naturally occuring amino acid except D, F or L
  MISC_FEATURE (154)..(154): Xaa can be any naturally occuring amino acid except A or R
  MISC_FEATURE (155)..(155): Xaa can be any naturally occuring amino acid except F or N
  MISC_FEATURE (156)..(156): Xaa can be any naturally occuring amino acid except D or F
  MISC_FEATURE (170)..(170): Xaa can be any naturally occuring amino acid except F, I or V
  MISC_FEATURE (188)..(188): Xaa can be any naturally occuring amino acid except D or L
  MISC_FEATURE (189)..(189): Xaa can be any naturally occuring amino acid except A or P
  MISC_FEATURE (190)..(190): Xaa can be any naturally occuring amino acid except Q or Y
  MISC_FEATURE (191)..(191): Xaa can be any naturally occuring amino acid except F or G
  MISC_FEATURE (193)..(193): Xaa can be any naturally occuring amino acid except K or L
  MISC_FEATURE (195)..(195): Xaa can be any naturally occuring amino acid except P or S
  MISC_FEATURE (196)..(196): Xaa can be any naturally occuring amino acid except P or Q
  MISC_FEATURE (211)..(211): Xaa can be any naturally occuring amino acid except C, R or W
  MISC_FEATURE (222)..(222): Xaa can be any naturally occuring amino acid except Y
  MISC_FEATURE (223)..(223): Xaa can be any naturally occuring amino acid except A, K, R, T or V
  MISC_FEATURE (224)..(224): Xaa can be any naturally occuring amino acid except D
  MISC_FEATURE (225)..(225): Xaa can be any naturally occuring amino acid except D
  MISC_FEATURE (267)..(267): Xaa can be any naturally occuring amino acid except F, H, I, K, L, M, V or Y
  MISC_FEATURE (268)..(268): Xaa can be any naturally occuring amino acid except Y
  MISC_FEATURE (269)..(269): Xaa can be any naturally occuring amino acid except L or M
  MISC_FEATURE (270)..(270): Xaa can be any naturally occuring amino acid except D or G
  MISC_FEATURE (271)..(271): Xaa can be any naturally occuring amino acid except D or Y
  MISC_FEATURE (272)..(272): Xaa can be any naturally occuring amino acid except F, L, W or Y
  MISC_FEATURE (273)..(273): Xaa can be any naturally occuring amino acid except L or Q
  MISC_FEATURE (274)..(274): Xaa can be any naturally occuring amino acid except K or W
  MISC_FEATURE (295)..(295): Xaa can be any naturally occuring amino acid except K or P
  MISC_FEATURE (296)..(296): Xaa can be any naturally occuring amino acid except G or T
  MISC_FEATURE (297)..(297): Xaa can be any naturally occuring amino acid except N or P
  MISC_FEATURE (298)..(298): Xaa can be any naturally occuring amino acid except P or R
  MISC_FEATURE (299)..(299): Xaa can be any naturally occuring amino acid except I, L, Q, T or V
  MISC_FEATURE (300)..(300): Xaa can be any naturally occuring amino acid except F or L
  MISC_FEATURE (301)..(301): Xaa can be any naturally occuring amino acid except K or R
  MISC_FEATURE (302)..(302): Xaa can be any naturally occuring amino acid except E or R
  MISC_FEATURE (303)..(303): Xaa can be any naturally occuring amino acid except F or L
  MISC_FEATURE (304)..(304): Xaa can be any naturally occuring amino acid except D or L
  MISC_FEATURE (305)..(305): Xaa can be any naturally occuring amino acid except F, G or L
  MISC_FEATURE (306)..(306): Xaa can be any naturally occuring amino acid except R or T
  MISC_FEATURE (307)..(307): Xaa can be any naturally occuring amino acid except A or N
  MISC_FEATURE (308)..(308): Xaa can be any naturally occuring amino acid except D or G
  MISC_FEATURE (309)..(309): Xaa can be any naturally occuring amino acid except F, I or V
  MISC_FEATURE (310)..(310): Xaa can be any naturally occuring amino acid except C or D
  MISC_FEATURE (311)..(311): Xaa can be any naturally occuring amino acid except A or R
  MISC_FEATURE (312)..(312): Xaa can be any naturally occuring amino acid except L or Y
  MISC_FEATURE (313)..(313): Xaa can be any naturally occuring amino acid except F or W
  MISC_FEATURE (314)..(314): Xaa can be any naturally occuring amino acid except I or L
  MISC_FEATURE (315)..(315): Xaa can be any naturally occuring amino acid except P
  MISC_FEATURE (316)..(316): Xaa can be any naturally occuring amino acid except G or Q
  MISC_FEATURE (317)..(317): Xaa can be any naturally occuring amino acid except F or G
  MISC_FEATURE (318)..(318): Xaa can be any naturally occuring amino acid except A, K, R or T
  MISC_FEATURE (325)..(325): Xaa can be any naturally occuring amino acid except S or Y
  MISC_FEATURE (326)..(326): Xaa can be any naturally occuring amino acid except I, L or V
  MISC_FEATURE (327)..(327): Xaa can be any naturally occuring amino acid except L or P
  MISC_FEATURE (330)..(330): Xaa can be any naturally occuring amino acid except F, H, I, L, M, T, V or Y
  MISC_FEATURE (333)..(333): Xaa can be any naturally occuring amino acid except L
  MISC_FEATURE (343)..(343): Xaa can be any naturally occuring amino acid except A, C, D, E, G, H, I, K, L, M, N, Q, R, S, T or V
  MISC_FEATURE (359)..(359): Xaa can be any naturally occuring amino acid except A, C, F, I, L, M, T, V or Y
  MISC_FEATURE (402)..(402): Xaa can be any naturally occuring amino acid except M or V
  MISC_FEATURE (403)..(403): Xaa can be any naturally occuring amino acid except A or D
  MISC_FEATURE (404)..(404): Xaa can be any naturally occuring amino acid except A or D
  MISC_FEATURE (423)..(423): Xaa can be any naturally occuring amino acid except A, G or S
  MISC_FEATURE (429)..(429): Xaa can be any naturally occuring amino acid except G
  MISC_FEATURE (470)..(470): Xaa can be any naturally occuring amino acid except I, L or V
  MISC_FEATURE (487)..(487): Xaa can be any naturally occuring amino acid except C, D, G, H, K, N, P, Q, R, S or T
  MISC_FEATURE (522)..(522): Xaa can be any naturally occuring amino acid except F, I, W or Y
  MISC_FEATURE (524)..(524): Xaa can be any naturally occuring amino acid except D
  MISC_FEATURE (529)..(529): Xaa can be any naturally occuring amino acid except D or L
  MISC_FEATURE (557)..(557): Xaa can be any naturally occuring amino acid except K, R or S
  MISC_FEATURE (558)..(558): Xaa can be any naturally occuring amino acid except A, G, K, Q or R
  MISC_FEATURE (559)..(559): Xaa can be any naturally occuring amino acid except Q, S or T
  MISC_FEATURE (560)..(560): Xaa can be any naturally occuring amino acid except H, N or R
  MISC_FEATURE (562)..(562): Xaa can be any naturally occuring amino acid except E
  MISC_FEATURE (565)..(565): Xaa can be any naturally occuring amino acid except A, E, K, Q or R
  MISC_FEATURE (569)..(569): Xaa can be any naturally occuring amino acid except A or E
  MISC_FEATURE (583)..(583): Xaa can be any naturally occuring amino acid except D
  MISC_FEATURE (584)..(584): Xaa can be any naturally occuring amino acid except A or S
  MISC_FEATURE (585)..(585): Xaa can be any naturally occuring amino acid except I, L or R
  MISC_FEATURE (586)..(586): Xaa can be any naturally occuring amino acid except D or Y
  MISC_FEATURE (590)..(590): Xaa can be any naturally occuring amino acid except S or T
  MISC_FEATURE (638)..(638): Xaa can be any naturally occuring amino acid except H, K, Q or R
  MISC_FEATURE (648)..(648): Xaa can be any naturally occuring amino acid except G
  MISC_FEATURE (653)..(653): Xaa can be any naturally occuring amino acid except D or Y
TLNIEDEHRLHETSKEPDVSLGSTWLSDFPQAWAETGGMGLAVRQAPLIIPLKATSTPVSIKXYXMSQEARLGIKPHIQRLLDQXILVPCQSPWXTXLLPVKXPGTNDYXPVQXLXEVXKRVEDIHPTVPNPYNLLSGLPPSHQWYTVLXLXXXXXCLRLHPTSQPLFAXEWRDPEMGISGQLTWTRXXXXFXNXXTLFDEALHRDLADFXIQHPDLILLQXXXXLLLAATSELDCQQGTRALLQTLGNLGYRASAKKAQICQKQVXXXXXXXXEGQRWLTEARKETVMGQPTPXXXXXXXXXXXXXXXXXXXXXXXXEMAAPLXXXTKXGTXFNWGPDQQKXYQEIKQALLTAPALGXPDLTKPFELFVDEKQGYAKGVLTQKLGPWRRPVAYLSKKLDPXXXGWPPCLRMVAAIAVLTKDXGKLTMXQPLVILAPHAVEALVKQPPDRWLSNARMTHYQALLLDTDRXQFGPVVALNPATLLPLXEEGLQHNCLDILAEAHGTRPDLTDQPLPDADHTWXTXGSSLXQEGQRKAGAAVTTETEVIWAKALPAGTXXXXAXLIXLTQXLKMAEGKKLNVYTXXXXAFAXAHIHGEIYRRRGLLTSEGKEIKNKDEILALLKALFLPKRLSIIHCPGXQKGHSAEARXNRMAXQAARKAAITETPDTSTLL

SEQ ID NO: 86 - protein, 560 aa, Simian immunodeficiency virus
  MISC_FEATURE (23)..(23): Xaa can be any naturally occuring amino acid except Q
  MISC_FEATURE (25)..(25): Xaa can be any naturally occuring amino acid except P
  MISC_FEATURE (45)..(45): Xaa can be any naturally occuring amino acid except G
  MISC_FEATURE (57)..(57): Xaa can be any naturally occuring amino acid except N
  MISC_FEATURE (59)..(59): Xaa can be any naturally occuring amino acid except P
  MISC_FEATURE (65)..(65): Xaa can be any naturally occuring amino acid except K
  MISC_FEATURE (72)..(72): Xaa can be any naturally occuring amino acid except R
  MISC_FEATURE (76)..(76): Xaa can be any naturally occuring amino acid except D
  MISC_FEATURE (78)..(78): Xaa can be any naturally occuring amino acid except R
  MISC_FEATURE (81)..(81): Xaa can be any naturally occuring amino acid except N
  MISC_FEATURE (110)..(110): Xaa can be any naturally occuring amino acid except D
  MISC_FEATURE (130)..(130): Xaa can be any naturally occuring amino acid except F
  MISC_FEATURE (149)..(149): Xaa can be any naturally occuring amino acid except L
  MISC_FEATURE (150)..(150): Xaa can be any naturally occuring amino acid except P
  MISC_FEATURE (151)..(151): Xaa can be any naturally occuring amino acid except Q
  MISC_FEATURE (152)..(152): Xaa can be any naturally occuring amino acid except G
  MISC_FEATURE (156)..(156): Xaa can be any naturally occuring amino acid except S
  MISC_FEATURE (157)..(157): Xaa can be any naturally occuring amino acid except P
  MISC_FEATURE (183)..(183): Xaa can be any naturally occuring amino acid except Y
  MISC_FEATURE (185)..(185): Xaa can be any naturally occuring amino acid except D
  MISC_FEATURE (186)..(186): Xaa can be any naturally occuring amino acid except D
  MISC_FEATURE (384)..(384): Xaa can be any naturally occuring amino acid except G
  MISC_FEATURE (443)..(443): Xaa can be any naturally occuring amino acid except D
  MISC_FEATURE (475)..(475): Xaa can be any naturally occuring amino acid except Q
  MISC_FEATURE (478)..(478): Xaa can be any naturally occuring amino acid except E
  MISC_FEATURE (481)..(481): Xaa can be any naturally occuring amino acid except A
  MISC_FEATURE (485)..(485): Xaa can be any naturally occuring amino acid except A
  MISC_FEATURE (498)..(498): Xaa can be any naturally occuring amino acid except D
  MISC_FEATURE (499)..(499): Xaa can be any naturally occuring amino acid except S
PISPIETIPVKLKPGMDGPRVKXWXLTEEKIKALTEICTEMEKEXKISRIGPENPYXTXIFAIKXKDSTKWXKLVXFXELXKRTQDFWEVQLGIPHPAGLKKKKSVTVLXVGDAYFSCPLDENFRKYTAXTIPSVNNETPGIRYQYNVXXXXWKGXXAIFQSTMTKILEPFRKNNPELVIYQXMXXLYVGSDLEITQHREAVERLRSHLLTWGFTTPDKKHQKEPPFLWMGYELHPDKWTVQTIQLPEKDTWTVNDIQQLVGKLNWASQIYPGIKVKQLCKLIRGAKALTEVVTLTREAELELAENREILKEPVHGAYYNPDKELIAEIQKQGQGQWTYQIYQDLHKNLKTGKYAKMRSTHTNDIRQLTEVVQKVALESIVIWXKTPKFRLPVQKEVWETWWTEYWQATWIPDWEFVNTPPLVKLWYQLETEPISGAETYYVXGAANRETKLGKAGFVTDRGRQKVTSISETTNQQAXLQXVLMXLQDAGQEVNIVTXXQYVLGIIHSQPDKSESELVNQIIEELIKKERIYLSWVPAHKGIGGNEQIDKLVSTGIRKVL

SEQ ID NO: 87 - protein, 559 aa, Human immunodeficiency virus 2
  MISC_FEATURE (23)..(23): Xaa can be any naturally occuring amino acid except Q
  MISC_FEATURE (25)..(25): Xaa can be any naturally occuring amino acid except P
  MISC_FEATURE (45)..(45): Xaa can be any naturally occuring amino acid except G
  MISC_FEATURE (57)..(57): Xaa can be any naturally occuring amino acid except N
  MISC_FEATURE (59)..(59): Xaa can be any naturally occuring amino acid except P
  MISC_FEATURE (65)..(65): Xaa can be any naturally occuring amino acid except K
  MISC_FEATURE (72)..(72): Xaa can be any naturally occuring amino acid except R
  MISC_FEATURE (76)..(76): Xaa can be any naturally occuring amino acid except D
  MISC_FEATURE (78)..(78): Xaa can be any naturally occuring amino acid except R
  MISC_FEATURE (81)..(81): Xaa can be any naturally occuring amino acid except N
  MISC_FEATURE (110)..(110): Xaa can be any naturally occuring amino acid except D
  MISC_FEATURE (130)..(130): Xaa can be any naturally occuring amino acid except F
  MISC_FEATURE (149)..(149): Xaa can be any naturally occuring amino acid except L
  MISC_FEATURE (150)..(150): Xaa can be any naturally occuring amino acid except P
  MISC_FEATURE (151)..(151): Xaa can be any naturally occuring amino acid except Q
  MISC_FEATURE (152)..(152): Xaa can be any naturally occuring amino acid except G
  MISC_FEATURE (156)..(156): Xaa can be any naturally occuring amino acid except S
  MISC_FEATURE (157)..(157): Xaa can be any naturally occuring amino acid except P
  MISC_FEATURE (183)..(183): Xaa can be any naturally occuring amino acid except Y
  MISC_FEATURE (185)..(185): Xaa can be any naturally occuring amino acid except D
  MISC_FEATURE (186)..(186): Xaa can be any naturally occuring amino acid except D
  MISC_FEATURE (383)..(383): Xaa can be any naturally occuring amino acid except G
  MISC_FEATURE (442)..(442): Xaa can be any naturally occuring amino acid except D
  MISC_FEATURE (474)..(474): Xaa can be any naturally occuring amino acid except Q
  MISC_FEATURE (477)..(477): Xaa can be any naturally occuring amino acid except E
  MISC_FEATURE (480)..(480): Xaa can be any naturally occuring amino acid except A
  MISC_FEATURE (484)..(484): Xaa can be any naturally occuring amino acid except A
  MISC_FEATURE (497)..(497): Xaa can be any naturally occuring amino acid except D
  MISC_FEATURE (498)..(498): Xaa can be any naturally occuring amino acid except S
PVARIEPVKVQLKPEKDGPKIRXWXLSKEKILALKEICEKMEKEXQLEEAPPTNPYXSXTFAIKXKDKNKWXMLIXFXELXKVTQEFTEVQLGIPHPAGLASKKRITVLXVGDAYFSVPLDPDFRQYTAXTLPAVNNAEPGKRYLYKVXXXXWKGXXAIFQYTMAKVLDPFRKANNDVTIIQXMXXILVASDRSDLEHDRVVSQLKELLNNMGFSTPEEKFQKDPPFKWMGYELWPKKWKLQKIQLPEKEVWTVNDIQKLVGVLNWAAQLFPGIKTRHICKLIRGKMTLTEEVQWTELAEAEFQENKIILEQEQEGSYYKEGVPLEATVQKNLANQWTYKIHQGDKILKVGKYAKVKNTHTNGVRLLAHVVQKIGKEALVIWXEIPMFHLPVERETWDQWWTDYWQVTWIPEWDFVSTPPLIRLAYNLVKDPLEGVETYYTXGSCNKASKEGKAGYVTDRGKDKVKPLEQTTNXQAXLEXFALXLQDSGPQVNIIVXXQYVMGIVAAQPTETESPIVREIIEEMIKKEKIYVGWVPAHKGLGGNQEVDHLVSQGIRQIL

SEQ ID NO: 88 - protein, 556 aa, Feline immunodeficiency virus
  MISC_FEATURE (25)..(25): Xaa can be any naturally occuring amino acid except Q
  MISC_FEATURE (27)..(27): Xaa can be any naturally occuring amino acid except P
  MISC_FEATURE (47)..(47): Xaa can be any naturally occuring amino acid except G
  MISC_FEATURE (59)..(59): Xaa can be any naturally occuring amino acid except N
  MISC_FEATURE (61)..(61): Xaa can be any naturally occuring amino acid except P
  MISC_FEATURE (67)..(67): Xaa can be any naturally occuring amino acid except K
  MISC_FEATURE (73)..(73): Xaa can be any naturally occuring amino acid except R
  MISC_FEATURE (77)..(77): Xaa can be any naturally occuring amino acid except D
  MISC_FEATURE (79)..(79): Xaa can be any naturally occuring amino acid except R
  MISC_FEATURE (82)..(82): Xaa can be any naturally occuring amino acid except N
  MISC_FEATURE (111)..(111): Xaa can be any naturally occuring amino acid except D
  MISC_FEATURE (131)..(131): Xaa can be any naturally occuring amino acid except F
  MISC_FEATURE (150)..(150): Xaa can be any naturally occuring amino acid except L
  MISC_FEATURE (151)..(151): Xaa can be any naturally occuring amino acid except P
  MISC_FEATURE (152)..(152): Xaa can be any naturally occuring amino acid except Q
  MISC_FEATURE (153)..(153): Xaa can be any naturally occuring amino acid except G
  MISC_FEATURE (157)..(157): Xaa can be any naturally occuring amino acid except S
  MISC_FEATURE (158)..(158): Xaa can be any naturally occuring amino acid except P
  MISC_FEATURE (184)..(184): Xaa can be any naturally occuring amino acid except Y
  MISC_FEATURE (186)..(186): Xaa can be any naturally occuring amino acid except D
  MISC_FEATURE (187)..(187): Xaa can be any naturally occuring amino acid except D
  MISC_FEATURE (386)..(386): Xaa can be any naturally occuring amino acid except G
  MISC_FEATURE (447)..(447): Xaa can be any naturally occuring amino acid except D
  MISC_FEATURE (477)..(477): Xaa can be any naturally occuring amino acid except Q
  MISC_FEATURE (480)..(480): Xaa can be any naturally occuring amino acid except E
  MISC_FEATURE (483)..(483): Xaa can be any naturally occuring amino acid except A
  MISC_FEATURE (487)..(487): Xaa can be any naturally occuring amino acid except A
  MISC_FEATURE (500)..(500): Xaa can be any naturally occuring amino acid except D
  MISC_FEATURE (501)..(501): Xaa can be any naturally occuring amino acid except S
AQISDKIPIVKVKMKDPNKGPQIKXWXLSNEKIEALTEIVERLEREXKVKRADPNNPWXTXVFAIKXKSGKWXMLIXFXELXKLTEKGAEVQLGLPHPAGLQMKKQITVLXIGDAYFTNPLDPDYAPYTAXTLPRKNNAGPGRRFVWCSXXXXWILXXLIYQSTLDNIIQPFIRQNPQLDIYQXMXXIYIGSNLSKKEHKEKVEELRKLLLWWGFETPEDKLQEEPPYKWMGYELHPLTWTIQQKQLEIPEKPTLNELQKLAGKINWASQTIPELSIKSLTNMTRGNQNLNSTREWTEEARLEVQKAKRAIEEQVQLGYYDPSKELYAKLSLVGPHQISYQVYQKCPEKILWYGKMSRQKKKAENTCDIALRACYKIREESIIRIXKEPRYEIPTSREAWESNLINSPYLKAPPPEVDYIHAALNIKRALSMIKDPPISGAETWYIXGGRKLGKAAKAAYWTDTGKWQVMELEGSNXKAXIQXLLLXLKAGPEEMNIITXXQYMINILSQQPDKMEGIWQEVLEELEKKTAIFIDWVPGHKGIPGNEEVDKLCQTM

SEQ ID NO: 89 - protein, 718 aa, Equine infectious anemia virus
  MISC_FEATURE (14)..(14): Xaa can be any naturally occuring amino acid except Q
  MISC_FEATURE (16)..(16): Xaa can be any naturally occuring amino acid except P
  MISC_FEATURE (36)..(36): Xaa can be any naturally occuring amino acid except G
  MISC_FEATURE (48)..(48): Xaa can be any naturally occuring amino acid except N
  MISC_FEATURE (50)..(50): Xaa can be any naturally occuring amino acid except P
  MISC_FEATURE (56)..(56): Xaa can be any naturally occuring amino acid except K
  MISC_FEATURE (62)..(62): Xaa can be any naturally occuring amino acid except R
  MISC_FEATURE (66)..(66): Xaa can be any naturally occuring amino acid except D
  MISC_FEATURE (68)..(68): Xaa can be any naturally occuring amino acid except R
  MISC_FEATURE (71)..(71): Xaa can be any naturally occuring amino acid except N
  MISC_FEATURE (100)..(100): Xaa can be any naturally occuring amino acid except D
  MISC_FEATURE (120)..(120): Xaa can be any naturally occuring amino acid except F
  MISC_FEATURE (139)..(139): Xaa can be any naturally occuring amino acid except L
  MISC_FEATURE (140)..(140): Xaa can be any naturally occuring amino acid except P
  MISC_FEATURE (141)..(141): Xaa can be any naturally occuring amino acid except Q
  MISC_FEATURE (142)..(142): Xaa can be any naturally occuring amino acid except G
  MISC_FEATURE (146)..(146): Xaa can be any naturally occuring amino acid except S
  MISC_FEATURE (147)..(147): Xaa can be any naturally occuring amino acid except P
  MISC_FEATURE (173)..(173): Xaa can be any naturally occuring amino acid except Y
  MISC_FEATURE (175)..(175): Xaa can be any naturally occuring amino acid except D
  MISC_FEATURE (176)..(176): Xaa can be any naturally occuring amino acid except D
  MISC_FEATURE (372)..(372): Xaa can be any naturally occuring amino acid except G
  MISC_FEATURE (430)..(430): Xaa can be any naturally occuring amino acid except D
  MISC_FEATURE (460)..(460): Xaa can be any naturally occuring amino acid except Q
  MISC_FEATURE (463)..(463): Xaa can be any naturally occuring amino acid except E
  MISC_FEATURE (466)..(466): Xaa can be any naturally occuring amino acid except A
  MISC_FEATURE (470)..(470): Xaa can be any naturally occuring amino acid except A
  MISC_FEATURE (484)..(484): Xaa can be any naturally occuring amino acid except D
  MISC_FEATURE (485)..(485): Xaa can be any naturally occuring amino acid except S
IELKEGTMGPKIPXWXLTKEKLEGAKETVQRLLSEXKISEASDNNPYXSXIFVIKXRSGKWXLLQXLXELXKTVQVGTEISRGLPHPGGLIKCKHMTVLXIGDAYFTIPLDPEFRPYTAXTIPSINHQEPDKRYVWKCXXXXFVLXXYIYQKTLQEILQPFRERYPEVQLYQXMXXLFVGSNGSKKQHKELIIELRAILQKGFETPDDKLQEVPPYSWLGYQLCPENWKVQKMQLDMVKNPTLNDVQKLMGNITWMSSGVPGLTVKHIAATTKGCLELNQKVIWTEEAQKELEENNEKIKNAQGLQYYNPEEEMLCEVEITKNYEATYVIKQSQGILWAGKKIMKANKGWSTVKNLMLLLQHVATESITRVXKCPTFKVPFTKEQVMWEMQKGWYYSWLPEIVYTHQVVHDDWRMKLVEEPTSGITIYTXGGKQNGEGIAAYVTSNGRTKQKRLGPVTHXVAXRMXIQMXLEDTRDKQVNIVTXXYYCWKNITEGLGLEGPQNPWWPIIQNIREKEIVYFAWVPGHKGIYGNQLADEAAKIKEEIMLAYQGTQIKEKRDEDAGFDLCVPYDIMIPVSDTKIIPTDVKIQVPPNSFGWVTGKSSMAKQGLLINGGIIDEGYTGEIQVICTNIGKSNIKLIEGQKFAQLIILQHHSNSRQPWDENKISQRGDKGFGSTGVFWVENIQEAQDEHENWHTSPKILARNYKIPLTVAKQITQE

SEQ ID NO: 90 - protein, 713 aa, Caprine arthritis encephalitis virus
  MISC_FEATURE (18)..(18): Xaa can be any naturally occuring amino acid except Q
  MISC_FEATURE (20)..(20): Xaa can be any naturally occuring amino acid except P
  MISC_FEATURE (40)..(40): Xaa can be any naturally occuring amino acid except G
  MISC_FEATURE (52)..(52): Xaa can be any naturally occuring amino acid except N
  MISC_FEATURE (54)..(54): Xaa can be any naturally occuring amino acid except P
  MISC_FEATURE (60)..(60): Xaa can be any naturally occuring amino acid except K
  MISC_FEATURE (66)..(66): Xaa can be any naturally occuring amino acid except R
  MISC_FEATURE (70)..(70): Xaa can be any naturally occuring amino acid except D
  MISC_FEATURE (72)..(72): Xaa can be any naturally occuring amino acid except R
  MISC_FEATURE (75)..(75): Xaa can be any naturally occuring amino acid except N
  MISC_FEATURE (104)..(104): Xaa can be any naturally occuring amino acid except D
  MISC_FEATURE (124)..(124): Xaa can be any naturally occuring amino acid except F
  MISC_FEATURE (143)..(143): Xaa can be any naturally occuring amino acid except L
  MISC_FEATURE (144)..(144): Xaa can be any naturally occuring amino acid except P
  MISC_FEATURE (145)..(145): Xaa can be any naturally occuring amino acid except Q
  MISC_FEATURE (146)..(146): Xaa can be any naturally occuring amino acid except G
  MISC_FEATURE (150)..(150): Xaa can be any naturally occuring amino acid except S
  MISC_FEATURE (151)..(151): Xaa can be any naturally occuring amino acid except P
  MISC_FEATURE (177)..(177): Xaa can be any naturally occuring amino acid except Y
  MISC_FEATURE (179)..(179): Xaa can be any naturally occuring amino acid except D
  MISC_FEATURE (180)..(180): Xaa can be any naturally occuring amino acid except D
  MISC_FEATURE (375)..(375): Xaa can be any naturally occuring amino acid except G
  MISC_FEATURE (432)..(432): Xaa can be any naturally occuring amino acid except D
  MISC_FEATURE (461)..(461): Xaa can be any naturally occuring amino acid except Q
  MISC_FEATURE (464)..(464): Xaa can be any naturally occuring amino acid except E
  MISC_FEATURE (467)..(467): Xaa can be any naturally occuring amino acid except A
  MISC_FEATURE (471)..(471): Xaa can be any naturally occuring amino acid except A
  MISC_FEATURE (484)..(484): Xaa can be any naturally occuring amino acid except D
  MISC_FEATURE (485)..(485): Xaa can be any naturally occuring amino acid except S
PITKVKLKEGCTGPHVPXWXLTEEKLKGLTEIIDKLVEEXKLGKAPPHWTCXTXIFCIKXKSGKWXMLIXFXELXKQTEDLTEAQLGLPHPGGLQKKKHVTILXIGDAYFTIPLYEPYREYTCXTLLSPNNLGPCKRYYWKVXXXXWKLXXSVYQFTMQEILEDWIQQHPEIQFGIXMXXIYIGSDLEIKKHREIVKDLANYIAQYGFTLPEEKRQKGYPAKWLGFELHPQTWKFQKHTLPELTKGTITLNKLQKLVGELVWRQSIIGKSIPNILKLMEGDRELQSERKIEEVHVKEWEACRKKLEEMEGNYYNKDKDVYGQLAWGDKAIEYIVYQEKGKPLWVNVVHNIKNLSIPQQVIKAAQKLTQEVIIRTXKIPWILLPGKEEDWRLELQLGNITWMPKFWSCYRGHTRWRKRNIIEEVVEGPTYYTXGGKKNKVGSLGFIVSTGEKFRKHEEGTNXQLXLRXIEEXLKQGPQTMNLVTXXRYAFEFLLRNWDEEVIKNPIQARIMEIAHKKDRIGVHWVPGHKGIPQNEEIDKYISEIFLAKEGEGILPKREEDAGYDLICPEEVTIEPGQVKCIPIELRLNLKKSQWAMIATKSSMAAKGVFTQGGIIDSGYQGQIQVIMYNSNKIAVVIPQGRKFAQLILMDKKHGKLEPWGESRKTERGEKGFGSTGMYWIENIPLAEEDHTKWHQDARSLHLEFEIPRTAAEDI

SEQ ID NO: 91 - protein, 571 aa, Maedi visna virus
  MISC_FEATURE (26)..(26): Xaa can be any naturally occuring amino acid except Q
  MISC_FEATURE (28)..(28): Xaa can be any naturally occuring amino acid except P
  MISC_FEATURE (48)..(48): Xaa can be any naturally occuring amino acid except G
  MISC_FEATURE (60)..(60): Xaa can be any naturally occuring amino acid except N
  MISC_FEATURE (62)..(62): Xaa can be any naturally occuring amino acid except P
  MISC_FEATURE (68)..(68): Xaa can be any naturally occuring amino acid except K
  MISC_FEATURE (74)..(74): Xaa can be any naturally occuring amino acid except R
  MISC_FEATURE (78)..(78): Xaa can be any naturally occuring amino acid except D
  MISC_FEATURE (80)..(80): Xaa can be any naturally occuring amino acid except R
  MISC_FEATURE (83)..(83): Xaa can be any naturally occuring amino acid except N
  MISC_FEATURE (112)..(112): Xaa can be any naturally occuring amino acid except D
  MISC_FEATURE (132)..(132): Xaa can be any naturally occuring amino acid except F
  MISC_FEATURE (151)..(151): Xaa can be any naturally occuring amino acid except L
  MISC_FEATURE (152)..(152): Xaa can be any naturally occuring amino acid except P
  MISC_FEATURE (153)..(153): Xaa can be any naturally occuring amino acid except Q
  MISC_FEATURE (154)..(154): Xaa can be any naturally occuring amino acid except G
  MISC_FEATURE (158)..(158): Xaa can be any naturally occuring amino acid except S
  MISC_FEATURE (159)..(159): Xaa can be any naturally occuring amino acid except P
  MISC_FEATURE (185)..(185): Xaa can be any naturally occuring amino acid except Y
  MISC_FEATURE (187)..(187): Xaa can be any naturally occuring amino acid except D
  MISC_FEATURE (188)..(188): Xaa can be any naturally occuring amino acid except D
  MISC_FEATURE (383)..(383): Xaa can be any naturally occuring amino acid except G
  MISC_FEATURE (440)..(440): Xaa can be any naturally occuring amino acid except D
  MISC_FEATURE (469)..(469): Xaa can be any naturally occuring amino acid except Q
  MISC_FEATURE (472)..(472): Xaa can be any naturally occuring amino acid except E
  MISC_FEATURE (475)..(475): Xaa can be any naturally occuring amino acid except A
  MISC_FEATURE (479)..(479): Xaa can be any naturally occuring amino acid except A
  MISC_FEATURE (492)..(492): Xaa can be any naturally occuring amino acid except D
  MISC_FEATURE (493)..(493): Xaa can be any naturally occuring amino acid except S
ANLEEKKIPSTRVRLKEGCKGPHIAXWXLTQEKLEGLKEIVDRLEKEXKVGRAPPHWTCXTXIFCIKXKSGKWXMLIXFXELXKQTEDLAEAQLGLPHPGGLQRKKHVTILXIGDAYFTIPLYEPYRQYTCXTMLSPNNLGPCVRYYWKVXXXXWKLXXAVYQFTMQKILRGWIEEHPMIQFGIXMXXIYIGSDLGLEEHRGIVNELASYIAQYGFMLPEDKRQEGYPAKWLGFELHPEKWKFQKHTLPEITEGPITLNKLQKLVGDLVWRQSLIGKSIPNILKLMEGDRALQSERYIESIHVREWEACRQKLKEMEGNYYDEEKDIYGQLDWGNKAIEYIVFQEKGKPLWVNVVHSIKNLSQAQQIIKAAQKLTQEVIIRTXKIPWILLPGREEDWILELQMGNINWMPSFWSCYKGSVRWKKRNVIAELVPGPTYYTXGGKKNGRGSLGYIASTGEKFRIHEEGTNXQLXLRXIEEXCKQGPEKMNIVTXXRYAYEFMLRNWDEEVIRNPIQARIMELVHNKEKIGVHWVPGHKGIPQNEEIDRYISEIFLAKEGRGILQKRAEDAGYD

SEQ ID NO: 92 - protein, 631 aa, Bovine immunodeficiency virus
  MISC_FEATURE (36)..(36): Xaa can be any naturally occuring amino acid except Q
  MISC_FEATURE (38)..(38): Xaa can be any naturally occuring amino acid except P
  MISC_FEATURE (58)..(58): Xaa can be any naturally occuring amino acid except G
  MISC_FEATURE (70)..(70): Xaa can be any naturally occuring amino acid except N
  MISC_FEATURE (72)..(72): Xaa can be any naturally occuring amino acid except P
  MISC_FEATURE (78)..(78): Xaa can be any naturally occuring amino acid except K
  MISC_FEATURE (85)..(85): Xaa can be any naturally occuring amino acid except R
  MISC_FEATURE (89)..(89): Xaa can be any naturally occuring amino acid except D
  MISC_FEATURE (91)..(91): Xaa can be any naturally occuring amino acid except R
  MISC_FEATURE (94)..(94): Xaa can be any naturally occuring amino acid except N
  MISC_FEATURE (123)..(123): Xaa can be any naturally occuring amino acid except D
  MISC_FEATURE (143)..(143): Xaa can be any naturally occuring amino acid except F
  MISC_FEATURE (162)..(162): Xaa can be any naturally occuring amino acid except L
  MISC_FEATURE (163)..(163): Xaa can be any naturally occuring amino acid except P
  MISC_FEATURE (164)..(164): Xaa can be any naturally occuring amino acid except Q
  MISC_FEATURE (165)..(165): Xaa can be any naturally occuring amino acid except G
  MISC_FEATURE (169)..(169): Xaa can be any naturally occuring amino acid except S
  MISC_FEATURE (170)..(170): Xaa can be any naturally occuring amino acid except P
  MISC_FEATURE (196)..(196): Xaa can be any naturally occuring amino acid except Y
  MISC_FEATURE (198)..(198): Xaa can be any naturally occuring amino acid except D
  MISC_FEATURE (199)..(199): Xaa can be any naturally occuring amino acid except D
  MISC_FEATURE (390)..(390): Xaa can be any naturally occuring amino acid except G
  MISC_FEATURE (446)..(446): Xaa can be any naturally occuring amino acid except D
  MISC_FEATURE (474)..(474): Xaa can be any naturally occuring amino acid except Q
  MISC_FEATURE (477)..(477): Xaa can be any naturally occuring amino acid except E
  MISC_FEATURE (480)..(480): Xaa can be any naturally occuring amino acid except A
  MISC_FEATURE (484)..(484): Xaa can be any naturally occuring amino acid except A
  MISC_FEATURE (497)..(497): Xaa can be any naturally occuring amino acid except D
  MISC_FEATURE (498)..(498): Xaa can be any naturally occuring amino acid except S
RSLLRSIVTCFTLLVHTEKIEPLPVKVRGPGPKVPXWXLTKEKYQALKEIVKDLLAEXKISEAAWDNPYXTXVFVIKXKGTGRWXMLMXFXELXKITVKGQEFSTGLPYPPGIKECEHLTAIXIKDAYFTIPLHEDFRPFTAXSVVPVNREGPIERFQWNVXXXXWVCXXAIYQTTTQKIIENIKKSHPDVMLYQXMXXLLIGSNRDDHKQIVQEIRDKLGSYGFKTPDEKVQEERVKWIGFELTPKKWRFQPRQLKIKNPLTVNELQQLVGNCVWVQPEVKIPLYPLTDLLRDKTNLQEKIQLTPEAIKCVEEFNLKLKDPEWKDRIREGAELVIKIQMVPRGIVFDLLQDGNPIWGGVKGLNYDHSNKIKKILRTMNELNRTVVIMTXREASFLLPGSSEDWEAALQKEESLTQIFPVKFYRHSCRWTSICGPVRENLTTYYTXGGKKGKTAAAVYWCEGRTKSKVFPGTNXQAXLKXICMXLLDGPPKMNIITXXRYAYEGMREEPETWAREGIWLEIAKILPFKQYVGVGWVPAHKGIGGNTEADEGVKKALEQMAPCSPPEAILLKPGEKQNLETGIYMQGLRPQSFLPRADLPVAITGTMVDSELQLQLLNIGTEHIRIQKDEVF

SEQ ID NO: 93 - protein, 572 aa, Avian leukosis virus
  MISC_FEATURE (23)..(23): Xaa can be any naturally occuring amino acid except Q
  MISC_FEATURE (25)..(25): Xaa can be any naturally occuring amino acid except D, G, H, K, N, P, Q, R, S or T
  MISC_FEATURE (45)..(45): Xaa can be any naturally occuring amino acid except G
  MISC_FEATURE (55)..(55): Xaa can be any naturally occuring amino acid except N
  MISC_FEATURE (57)..(57): Xaa can be any naturally occuring amino acid except P
  MISC_FEATURE (63)..(63): Xaa can be any naturally occuring amino acid except K
  MISC_FEATURE (69)..(69): Xaa can be any naturally occuring amino acid except H, K or R
  MISC_FEATURE (73)..(73): Xaa can be any naturally occuring amino acid except D
  MISC_FEATURE (75)..(75): Xaa can be any naturally occuring amino acid except R
  MISC_FEATURE (78)..(78): Xaa can be any naturally occuring amino acid except N
  MISC_FEATURE (107)..(107): Xaa can be any naturally occuring amino acid except D
  MISC_FEATURE (127)..(127): Xaa can be any naturally occuring amino acid except F
  MISC_FEATURE (146)..(146): Xaa can be any naturally occuring amino acid except L
  MISC_FEATURE (147)..(147): Xaa can be any naturally occuring amino acid except P
  MISC_FEATURE (148)..(148): Xaa can be any naturally occuring amino acid except Q
  MISC_FEATURE (149)..(149): Xaa can be any naturally occuring amino acid except G
  MISC_FEATURE (153)..(153): Xaa can be any naturally occuring amino acid except S
  MISC_FEATURE (154)..(154): Xaa can be any naturally occuring amino acid except P
  MISC_FEATURE (180)..(180): Xaa can be any naturally occuring amino acid except F or Y
  MISC_FEATURE (182)..(182): Xaa can be any naturally occuring amino acid except D
  MISC_FEATURE (183)..(183): Xaa can be any naturally occuring amino acid except D
  MISC_FEATURE (381)..(381): Xaa can be any naturally occuring amino acid except G
  MISC_FEATURE (450)..(450): Xaa can be any naturally occuring amino acid except D
  MISC_FEATURE (481)..(481): Xaa can be any naturally occuring amino acid except K, Q or R
  MISC_FEATURE (484)..(484): Xaa can be any naturally occuring amino acid except E
  MISC_FEATURE (487)..(487): Xaa can be any naturally occuring amino acid except A or V
  MISC_FEATURE (491)..(491): Xaa can be any naturally occuring amino acid except A, I, L, S, T or V
  MISC_FEATURE (505)..(505): Xaa can be any naturally occuring amino acid except D
  MISC_FEATURE (506)..(506): Xaa can be any naturally occuring amino acid except S
TVALHLAIPLKWKPDHTPVWIDXWXLPEGKLVALTQLVEKELQLXHIEPSLSCWXTXVFVIRXASGSYXLLHXLXAVXAKLVPFGAVQQGAPVLSALPRGWPLMVLXLKDCFFSIPLAEQDREAFAXTLPSVNNQAPARRFQWKVXXXXMTCXXTICQLVVGQVLEPLRLKHPSLRMLHXMXXLLLAASSHDGLEAAGEEVISTLERAGFTISPDKIQREPGVQYLGYKLGSTYVAPVGLVAEPRIATLWDVQKLVGSLQWLRPALGIPPRLMGPFYEQLRGSDPNEAREWNLDMKMAWREIVQLSTTAALERWDPALPLEGAVARCEQGAIGVLGQGLSTHPRPCLWLFSTQPTKAFTAWLEVLTLLITKLRASAVRTFXKEVDILLLPACFREDLPLPEGILLALKGFAGKIRSSDTPSIFDIARPLHVSLKVRVTDHPVPGPTVFTXASSSTHKGVVVWREGPRWEIKEIADSGASVXQLXARAVAMXLLLWPTTPTNVVTXXAFVAKMLLKMGQEGVPSTAAAFILEDALSQRSAMAAVLHVRSHSEVPGFFTEGNDVADSQATFQAY

SEQ ID NO: 94 - protein, 751 aa, Human spumaretrovirus
  MISC_FEATURE (167)..(167): Xaa can be any naturally occuring amino acid except Q
  MISC_FEATURE (169)..(169): Xaa can be any naturally occuring amino acid except K, P or R
  MISC_FEATURE (189)..(189): Xaa can be any naturally occuring amino acid except G
  MISC_FEATURE (199)..(199): Xaa can be any naturally occuring amino acid except N
  MISC_FEATURE (201)..(201): Xaa can be any naturally occuring amino acid except P
  MISC_FEATURE (207)..(207): Xaa can be any naturally occuring amino acid except K
  MISC_FEATURE (213)..(213): Xaa can be any naturally occuring amino acid except R
  MISC_FEATURE (217)..(217): Xaa can be any naturally occuring amino acid except D or G
  MISC_FEATURE (219)..(219): Xaa can be any naturally occuring amino acid except R
  MISC_FEATURE (222)..(222): Xaa can be any naturally occuring amino acid except N
  MISC_FEATURE (252)..(252): Xaa can be any naturally occuring amino acid except D
  MISC_FEATURE (272)..(272): Xaa can be any naturally occuring amino acid except F
  MISC_FEATURE (284)..(284): Xaa can be any naturally occuring amino acid except L
  MISC_FEATURE (285)..(285): Xaa can be any naturally occuring amino acid except P
  MISC_FEATURE (286)..(286): Xaa can be any naturally occuring amino acid except Q
  MISC_FEATURE (287)..(287): Xaa can be any naturally occuring amino acid except G
  MISC_FEATURE (291)..(291): Xaa can be any naturally occuring amino acid except S
  MISC_FEATURE (292)..(292): Xaa can be any naturally occuring amino acid except P
  MISC_FEATURE (312)..(312): Xaa can be any naturally occuring amino acid except Y
  MISC_FEATURE (314)..(314): Xaa can be any naturally occuring amino acid except D
  MISC_FEATURE (315)..(315): Xaa can be any naturally occuring amino acid except D
  MISC_FEATURE (519)..(519): Xaa can be any naturally occuring amino acid except G
  MISC_FEATURE (599)..(599): Xaa can be any naturally occuring amino acid except D
  MISC_FEATURE (643)..(643): Xaa can be any naturally occuring amino acid except Q
  MISC_FEATURE (646)..(646): Xaa can be any naturally occuring amino acid except E
  MISC_FEATURE (649)..(649): Xaa can be any naturally occuring amino acid except A
  MISC_FEATURE (653)..(653): Xaa can be any naturally occuring amino acid except A
  MISC_FEATURE (669)..(669): Xaa can be any naturally occuring amino acid except D
  MISC_FEATURE (670)..(670): Xaa can be any naturally occuring amino acid except S
MNPLQLLQPLPAEIKGTKLLAHWDSGATITCIPESFLEDEQPIKKTLIKTIHGEKQQNVYYVTFKVKGRKVEAEVIASPYEYILLSPTDVPWLTQQPLQLTILVPLQEYQEKILSKTALPEDQKQQLKTLFVKYDNLWQHWENQVGHRKIRPHNIATGDYPPRPQKXYXINPKAKPSIQIVIDDLLKQXVLTPQNSTMXTXVYPVPXPDGRWXMVLXYXEVXKTIPLTAAQNQHSAGILATIVRQKYKTTLXLANGFWAHPITPESYWLTAXTWQGKQYCWTRXXXXFLNXXALFTADVVDLLKEIPNVQVXVXXIYLSHDDPKEHVQQLEKVFQILLQAGYVVSLKKSEIGQKTVEFLGFNITKEGRGLTDTFKTKLLNITPPKDLKQLQSILGLLNFARNFIPNFAELVQPLYNLIASAKGKYIEWSEENTKQLNMVIEALNTASNLEERLPEQRLVIKVNTSPSAGYVRYYNETGKKPIMYLNYVFSKAELKFSMLEKLLTTMHKALIKAMDLAMXQEILVYSPIVSMTKIQKTPLPERKALPIRWITWMTYLEDPRIQFHYDKTLPELKHIPDVYTSSQSPVKHPSQYEGVFYTXGSAIKSPDPTKSNNAGMGIVHATYKPEYQVLNQWSIPLGNHTAXMAXIAXVEFXCKKALKIPGPVLVITXXFYVAESANKELPYWKSNGFVNNKKKPLKHISKWKSIAECLSMKPDITIQHEKGISLQIPVFILKGNALADKLATQGSYVVN

SEQ ID NO: 95 - DNA, 12060 bp, Artificial sequence
  transcomplementation plasmid p8.9delta5' (p155)
ttgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagagtctataggcccacccccttggcttcttatgcgacggatcgatcccgtaataagcttcgaggtccgcggccggccgcgttgacgcgcacggcaagaggcgaggggcggcgactggtgagagatgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaataaagataggggggcaattaaaggaagctctattagatacaggagcagatgatacagtattagaagaaatgaatttgccaggaagatggaaaccaaaaatgatagggggaattggaggttttatcaaagtaagacagtatgatcagatactcatagaaatctgcggacataaagctataggtacagtattagtaggacctacacctgtcaacataattggaagaaatctgttgactcagattggctgcactttaaattttcccattagtcctattgagactgtaccagtaaaattaaagccaggaatggatggcccaaaagttaaacaatggccattgacagaagaaaaaataaaagcattagtagaaatttgtacagaaatggaaaaggaaggaaaaatttcaaaaattgggcctgaaaatccatacaatactccagtatttgccataaagaaaaaagacagtactaaatggagaaaattagtagatttcagagaacttaataagagaactcaagatttctgggaagttcaattaggaataccacatcctactgcatttaccatacctagtataaacaatgagacaccagggattagatatcagtacaatgtgcttccacagggatggaaaggatcaccagcaatattccagtgtagcatgacaaaaatcttagagccttttagaaaacaaaatccagacatagtcatctatcaatacatggatgatttgtatgtaggatctgacttagaaatagggcagcatagaacaaaaatagaggaactgagacaacatctgttgaggtggggatttaccacaccagacaaaaaacatcagaaagaacctccattcctttggatgggttatgaactccatcctgataaatggacagtacagcctatagtgctgccagaaaaggacagctggactgtcaatgacatacagaaattagtgggaaaattgaattgggcaagtcagatttatgcagggattaaagtaaggcaattatgtaaacttcttaggggaaccaaagcactaacagaagtagtaccactaacagaagaagcagagctagaactggcagaaaacagggagattctaaaagaaccggtacatggagtgtattatgacccatcaaaagacttaatagcagaaatacagaagcaggggcaaggccaatggacatatcaaatttatcaagagccatttaaaaatctgaaaacaggaaagtatgcaagaatgaagggtgcccacactaatgatgtgaaacaattaacagaggcagtacaaaaaatagccacagaaagcatagtaatatggggaaagactcctaaatttaaattacccatacaaaaggaaacatgggaagcatggtggacagagtattggcaagccacctggattcctgagtgggagtttgtcaatacccctcccttagtgaagttatggtaccagttagagaaagaacccataataggagcagaaactttctatgtagatggggcagccaatagggaaactaaattaggaaaagcaggatatgtaactgacagaggaagacaaaaagttgtccccctaacggacacaacaaatcagaagactgagttacaagcaattcatctagctttgcaggattcgggattagaagtaaacatagtgacagactcacaatatgcattgggaatcattcaagcacaaccagataagagtgaatcagagttagtcagtcaaataatagagcagttaataaaaaaggaaaaagtctacctggcatgggtaccagcacacaaaggaattggaggaaatgaacaagtagataaattggtcagtgctggaatcaggaaagtactatttttagatggaatagataaggcccaagaagaacatgagaaatatcacagtaattggagagcaatggctagtgattttaacctaccacctgtagtagcaaaagaaatagtagccagctgtgataaatgtcagctaaaaggggaagccatgcatggacaagtagactgtagcccaggaatatggcagctagattgtacacatttagaaggaaaagttatcttggtagcagttcatgtagccagtggatatatagaagcagaagtaattccagcagagacagggcaagaaacagcatacttcctcttaaaattagcaggaagatggccagtaaaaacagtacatacagacaatggcagcaatttcaccagtactacagttaaggccgcctgttggtgggcggggatcaagcaggaatttggcattccctacaatccccaaagtcaaggagtaatagaatctatgaataaagaattaaagaaaattataggacaggtaagagatcaggctgaacatcttaagacagcagtacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggaaaggaccagcaaagctcctctggaaaggtgaaggggcagtagtaatacaagataatagtgacataaaagtagtgccaagaagaaaagcaaagatcatcagggattatggaaaacagatggcaggtgatgattgtgtggcaagtagacaggatgaggattaacacatggaattctgcaacaactgctgtttatccatttcagaattgggtgtcgacatagcagaataggcgttactcgacagaggagagcaagaaatggagccagtagatcctagactagagccctggaagcatccaggaagtcagcctaaaactgcttgtaccaattgctattgtaaaaagtgttgctttcattgccaagtttgtttcatgacaaaagccttaggcatctcctatggcaggaagaagcggagacagcgacgaagagctcatcagaacagtcagactcatcaagcttctctatcaaagcagtaagtagtacatgtaatgcaacctataatagtagcaatagtagcattagtagtagcaataataatagcaatagttgtgtggtccatagtaatcatagaatataggaaaatggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatccttggcacttatctgggacgatctgcggagcctgtgcctcttcagctaccaccgcttgagagacttactcttgattgtaacgaggattgtggaacttctgggacgcagggggtgggaagccctcaaatattggtggaatctcctacaatattggagtcaggagctaaagaatagtgctgttagcttgctcaatgccacagccatagcagtagctgaggggacagatagggttatagaagtagtacaaggagcttgtagagctattcgccacatacctagaagaataagacagggcttggaaaggattttgctataagctcgaggccgccccggtgaccttcagaccttggcactggaggtggcccggcagaagcgcggcatcgtggatcagtgctgcaccagcatctgctctctctaccaactggagaactactgcaactaggcccaccactaccctgtccacccctctgcaatgaataaaacctttgaaagagcactacaagttgtgtgtacatgcgtgcatgtgcatatgtggtgcggggggaacatgagtggggctggctggagtggcgatgataagctgtcaaacatgagaattaattcttgaagacgaaagggcctcgtgatacgcctatttttataggttaatgtcatgataataatggtttcttagtctagaattaattccgtgtattctatagtgtcacctaaatcgtatgtgtatgatacataaggttatgtattaattgtagccgcgttctaacgacaatatgtacaagcctaattgtgtagcatctggcttactgaagcagaccctatcatctctctcgtaaactgccgtcagagtcggtttggttggacgaaccttctgagtttctggtaacgccgtcccgcacccggaaatggtcagcgaaccaatcagcagggtcatcgctagccagatcctctacgccggacgcatcgtggccggcatcaccggcgccacaggtgcggttgctggcgcctatatcgccgacatcaccgatggggaagatcgggctcgccacttcgggctcatgagcgcttgtttcggcgtgggtatggtggcaggccccgtggccgggggactgttgggcgccatctccttgcatgcaccattccttgcggcggcggtgctcaacggcctcaacctactactgggctgcttcctaatgcaggagtcgcataagggagagcgtcgaatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcacatgagcgaaaaatacatcgtcacctgggacatgttgcagatccatgcacgtaaactcgcaagccgactgatgccttctgaacaatggaaaggcattattgccgtaagccgtggcggtctgtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaatcttttcaacgcctggcactgccgggcgttgttctttttaacttcaggcgggttacaatagtttccagtaagtattctggaggctgcatccatgacacaggcaaacctgagcgaaaccctgttcaaaccccgctttaaacatcctgaaacctcgacgctagtccgccgctttaatcacggcgcacaaccgcctgtgcagtcggcccttgatggtaaaaccatccctcactggtatcgcatgattaaccgtctgatgtggatctggcgcggcattgacccacgcgaaatcctcgacgtccaggcacgtattgtgatgagcgatgccgaacgtaccgacgatgatttatacgatacggtgattggctaccgtggcggcaactggatttatgagtgggccccggatctttgtgaaggaaccttacttctgtggtgtgacataattggacaaactacctacagagatttaaagctctaaggtaaatataaaatttttaacccggatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccaaaaaagaagagaaaggtagaagaccccaaggactttccttcagaattgctaagttttttgagtcatgctgtgtttagtaatagaactcttgcttgctttgctatttacaccacaaaggaaaaagctgcactgctatacaagaaaattatggaaaaatattctgtaacctttataagtaggcataacagttataatcataacatactgttttttcttactccacacaggcatagagtgtctgctattaataactatgctcaaaaattgtgtacctttagctttttaatttgtaaaggggttaataaggaatatttgatgtatagtgccttgactagagatcataatcagccataccacatttgtagaggttttacttgctttaaaaaacctcccacacctccccctgaacctgaaacataaaatgaatgcaattgttgttgttgggctgcaggaattaattcgagctcgcccgaca

SEQ ID NO: 96 - DNA, 11363 bp, Artificial sequence
  transcomplementation plasmid p8.9delta3' (p154)
ttgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagagtctataggcccacccccttggcttcttatgcgacggatcgatcccgtaataagcttcgaggtccgcggccggccgcgttgacgcgcacggcaagaggcgaggggcggcgactggtgagagatgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaataaagataggggggcaattaaaggaagctctattagatacaggagcagatgatacagtattagaagaaatgaatttgccaggaagatggaaaccaaaaatgatagggggaattggaggttttatcaaagtaagacagtatgatcagatactcatagaaatctgcggacataaagctataggtacagtattagtaggacctacacctgtcaacataattggaagaaatctgttgactcagattggctgcactttaaattttcccattagtcctattgagactgtaccagtaaaattaaagccaggaatggatggcccaaaagttaaacaatggccattgacagaagaaaaaataaaagcattagtagaaatttgtacagaaatggaaaaggaaggaaaaatttcaaaaattgggcctgaaaatccatacaatactccagtatttgccataaagaaaaaagacagtactaaatggagaaaattagtagatttcagagaacttaataagagaactcaagatttctgggaagttcaattaggaataccacatcctgcagggttaaaacagaaaaaatcagtaacagtactggatgtgggcgatgcatatttttcagttcccttagataaagacttcaggaagtaaaattacccatacaaaaggaaacatgggaagcatggtggacagagtattggcaagccacctggattcctgagtgggagtttgtcaatacccctcccttagtgaagttatggtaccagttagagaaagaacccataataggagcagaaactttctatgtagatggggcagccaatagggaaactaaattaggaaaagcaggatatgtaactgacagaggaagacaaaaagttgtccccctaacggacacaacaaatcagaagactgagttacaagcaattcatctagctttgcaggattcgggattagaagtaaacatagtgacagactcacaatatgcattgggaatcattcaagcacaaccagataagagtgaatcagagttagtcagtcaaataatagagcagttaataaaaaaggaaaaagtctacctggcatgggtaccagcacacaaaggaattggaggaaatgaacaagtagataaattggtcagtgctggaatcaggaaagtactatttttagatggaatagataaggcccaagaagaacatgagaaatatcacagtaattggagagcaatggctagtgattttaacctaccacctgtagtagcaaaagaaatagtagccagctgtgataaatgtcagctaaaaggggaagccatgcatggacaagtagactgtagcccaggaatatggcagctagattgtacacatttagaaggaaaagttatcttggtagcagttcatgtagccagtggatatatagaagcagaagtaattccagcagagacagggcaagaaacagcatacttcctcttaaaattagcaggaagatggccagtaaaaacagtacatacagacaatggcagcaatttcaccagtactacagttaaggccgcctgttggtgggcggggatcaagcaggaatttggcattccctacaatccccaaagtcaaggagtaatagaatctatgaataaagaattaaagaaaattataggacaggtaagagatcaggctgaacatcttaagacagcagtacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggaaaggaccagcaaagctcctctggaaaggtgaaggggcagtagtaatacaagataatagtgacataaaagtagtgccaagaagaaaagcaaagatcatcagggattatggaaaacagatggcaggtgatgattgtgtggcaagtagacaggatgaggattaacacatggaattctgcaacaactgctgtttatccatttcagaattgggtgtcgacatagcagaataggcgttactcgacagaggagagcaagaaatggagccagtagatcctagactagagccctggaagcatccaggaagtcagcctaaaactgcttgtaccaattgctattgtaaaaagtgttgctttcattgccaagtttgtttcatgacaaaagccttaggcatctcctatggcaggaagaagcggagacagcgacgaagagctcatcagaacagtcagactcatcaagcttctctatcaaagcagtaagtagtacatgtaatgcaacctataatagtagcaatagtagcattagtagtagcaataataatagcaatagttgtgtggtccatagtaatcatagaatataggaaaatggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatccttggcacttatctgggacgatctgcggagcctgtgcctcttcagctaccaccgcttgagagacttactcttgattgtaacgaggattgtggaacttctgggacgcagggggtgggaagccctcaaatattggtggaatctcctacaatattggagtcaggagctaaagaatagtgctgttagcttgctcaatgccacagccatagcagtagctgaggggacagatagggttatagaagtagtacaaggagcttgtagagctattcgccacatacctagaagaataagacagggcttggaaaggattttgctataagctcgaggccgccccggtgaccttcagaccttggcactggaggtggcccggcagaagcgcggcatcgtggatcagtgctgcaccagcatctgctctctctaccaactggagaactactgcaactaggcccaccactaccctgtccacccctctgcaatgaataaaacctttgaaagagcactacaagttgtgtgtacatgcgtgcatgtgcatatgtggtgcggggggaacatgagtggggctggctggagtggcgatgataagctgtcaaacatgagaattaattcttgaagacgaaagggcctcgtgatacgcctatttttataggttaatgtcatgataataatggtttcttagtctagaattaattccgtgtattctatagtgtcacctaaatcgtatgtgtatgatacataaggttatgtattaattgtagccgcgttctaacgacaatatgtacaagcctaattgtgtagcatctggcttactgaagcagaccctatcatctctctcgtaaactgccgtcagagtcggtttggttggacgaaccttctgagtttctggtaacgccgtcccgcacccggaaatggtcagcgaaccaatcagcagggtcatcgctagccagatcctctacgccggacgcatcgtggccggcatcaccggcgccacaggtgcggttgctggcgcctatatcgccgacatcaccgatggggaagatcgggctcgccacttcgggctcatgagcgcttgtttcggcgtgggtatggtggcaggccccgtggccgggggactgttgggcgccatctccttgcatgcaccattccttgcggcggcggtgctcaacggcctcaacctactactgggctgcttcctaatgcaggagtcgcataagggagagcgtcgaatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcacatgagcgaaaaatacatcgtcacctgggacatgttgcagatccatgcacgtaaactcgcaagccgactgatgccttctgaacaatggaaaggcattattgccgtaagccgtggcggtctgtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaatcttttcaacgcctggcactgccgggcgttgttctttttaacttcaggcgggttacaatagtttccagtaagtattctggaggctgcatccatgacacaggcaaacctgagcgaaaccctgttcaaaccccgctttaaacatcctgaaacctcgacgctagtccgccgctttaatcacggcgcacaaccgcctgtgcagtcggcccttgatggtaaaaccatccctcactggtatcgcatgattaaccgtctgatgtggatctggcgcggcattgacccacgcgaaatcctcgacgtccaggcacgtattgtgatgagcgatgccgaacgtaccgacgatgatttatacgatacggtgattggctaccgtggcggcaactggatttatgagtgggccccggatctttgtgaaggaaccttacttctgtggtgtgacataattggacaaactacctacagagatttaaagctctaaggtaaatataaaatttttaacccggatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccaaaaaagaagagaaaggtagaagaccccaaggactttccttcagaattgctaagttttttgagtcatgctgtgtttagtaatagaactcttgcttgctttgctatttacaccacaaaggaaaaagctgcactgctatacaagaaaattatggaaaaatattctgtaacctttataagtaggcataacagttataatcataacatactgttttttcttactccacacaggcatagagtgtctgctattaataactatgctcaaaaattgtgtacctttagctttttaatttgtaaaggggttaataaggaatatttgatgtatagtgccttgactagagatcataatcagccataccacatttgtagaggttttacttgctttaaaaaacctcccacacctccccctgaacctgaaacataaaatgaatgcaattgttgttgttgggctgcaggaattaattcgagctcgcccgaca

SEQ ID NO: 97 - DNA, 11273 bp, Artificial sequence
  transcomplementation plasmid p8.9deltaRT (p156)
ttgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagagtctataggcccacccccttggcttcttatgcgacggatcgatcccgtaataagcttcgaggtccgcggccggccgcgttgacgcgcacggcaagaggcgaggggcggcgactggtgagagatgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaataaagataggggggcaattaaaggaagctctattagatacaggagcagatgatacagtattagaagaaatgaatttgccaggaagatggaaaccaaaaatgatagggggaattggaggttttatcaaagtaagacagtatgatcagatactcatagaaatctgcggacataaagctataggtacagtattagtaggacctacacctgtcaacataattggaagaaatctgttgactcagattggctgcactttaaattttcccattagtcctattgagactgtaccagtaaaattaaagccaggaatggatggcccaaaagttaaacaatggccattgacagaagaaaaaataaaagcattagtagaaatttgtacagaaatggaaaaggaaggaaaaatttcaaaaattgggcctgaaaatccatacaatactccagtatttgccataaagaaaaaagacagtactaaatggagaaaattagtagatttcagagaacttaataagagaactcaagatttctgggaagttcaattaggaataccacatccaaattacccatacaaaaggaaacatgggaagcatggtggacagagtattggcaagccacctggattcctgagtgggagtttgtcaatacccctcccttagtgaagttatggtaccagttagagaaagaacccataataggagcagaaactttctatgtagatggggcagccaatagggaaactaaattaggaaaagcaggatatgtaactgacagaggaagacaaaaagttgtccccctaacggacacaacaaatcagaagactgagttacaagcaattcatctagctttgcaggattcgggattagaagtaaacatagtgacagactcacaatatgcattgggaatcattcaagcacaaccagataagagtgaatcagagttagtcagtcaaataatagagcagttaataaaaaaggaaaaagtctacctggcatgggtaccagcacacaaaggaattggaggaaatgaacaagtagataaattggtcagtgctggaatcaggaaagtactatttttagatggaatagataaggcccaagaagaacatgagaaatatcacagtaattggagagcaatggctagtgattttaacctaccacctgtagtagcaaaagaaatagtagccagctgtgataaatgtcagctaaaaggggaagccatgcatggacaagtagactgtagcccaggaatatggcagctagattgtacacatttagaaggaaaagttatcttggtagcagttcatgtagccagtggatatatagaagcagaagtaattccagcagagacagggcaagaaacagcatacttcctcttaaaattagcaggaagatggccagtaaaaacagtacatacagacaatggcagcaatttcaccagtactacagttaaggccgcctgttggtgggcggggatcaagcaggaatttggcattccctacaatccccaaagtcaaggagtaatagaatctatgaataaagaattaaagaaaattataggacaggtaagagatcaggctgaacatcttaagacagcagtacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggaaaggaccagcaaagctcctctggaaaggtgaaggggcagtagtaatacaagataatagtgacataaaagtagtgccaagaagaaaagcaaagatcatcagggattatggaaaacagatggcaggtgatgattgtgtggcaagtagacaggatgaggattaacacatggaattctgcaacaactgctgtttatccatttcagaattgggtgtcgacatagcagaataggcgttactcgacagaggagagcaagaaatggagccagtagatcctagactagagccctggaagcatccaggaagtcagcctaaaactgcttgtaccaattgctattgtaaaaagtgttgctttcattgccaagtttgtttcatgacaaaagccttaggcatctcctatggcaggaagaagcggagacagcgacgaagagctcatcagaacagtcagactcatcaagcttctctatcaaagcagtaagtagtacatgtaatgcaacctataatagtagcaatagtagcattagtagtagcaataataatagcaatagttgtgtggtccatagtaatcatagaatataggaaaatggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatccttggcacttatctgggacgatctgcggagcctgtgcctcttcagctaccaccgcttgagagacttactcttgattgtaacgaggattgtggaacttctgggacgcagggggtgggaagccctcaaatattggtggaatctcctacaatattggagtcaggagctaaagaatagtgctgttagcttgctcaatgccacagccatagcagtagctgaggggacagatagggttatagaagtagtacaaggagcttgtagagctattcgccacatacctagaagaataagacagggcttggaaaggattttgctataagctcgaggccgccccggtgaccttcagaccttggcactggaggtggcccggcagaagcgcggcatcgtggatcagtgctgcaccagcatctgctctctctaccaactggagaactactgcaactaggcccaccactaccctgtccacccctctgcaatgaataaaacctttgaaagagcactacaagttgtgtgtacatgcgtgcatgtgcatatgtggtgcggggggaacatgagtggggctggctggagtggcgatgataagctgtcaaacatgagaattaattcttgaagacgaaagggcctcgtgatacgcctatttttataggttaatgtcatgataataatggtttcttagtctagaattaattccgtgtattctatagtgtcacctaaatcgtatgtgtatgatacataaggttatgtattaattgtagccgcgttctaacgacaatatgtacaagcctaattgtgtagcatctggcttactgaagcagaccctatcatctctctcgtaaactgccgtcagagtcggtttggttggacgaaccttctgagtttctggtaacgccgtcccgcacccggaaatggtcagcgaaccaatcagcagggtcatcgctagccagatcctctacgccggacgcatcgtggccggcatcaccggcgccacaggtgcggttgctggcgcctatatcgccgacatcaccgatggggaagatcgggctcgccacttcgggctcatgagcgcttgtttcggcgtgggtatggtggcaggccccgtggccgggggactgttgggcgccatctccttgcatgcaccattccttgcggcggcggtgctcaacggcctcaacctactactgggctgcttcctaatgcaggagtcgcataagggagagcgtcgaatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcacatgagcgaaaaatacatcgtcacctgggacatgttgcagatccatgcacgtaaactcgcaagccgactgatgccttctgaacaatggaaaggcattattgccgtaagccgtggcggtctgtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaatcttttcaacgcctggcactgccgggcgttgttctttttaacttcaggcgggttacaatagtttccagtaagtattctggaggctgcatccatgacacaggcaaacctgagcgaaaccctgttcaaaccccgctttaaacatcctgaaacctcgacgctagtccgccgctttaatcacggcgcacaaccgcctgtgcagtcggcccttgatggtaaaaccatccctcactggtatcgcatgattaaccgtctgatgtggatctggcgcggcattgacccacgcgaaatcctcgacgtccaggcacgtattgtgatgagcgatgccgaacgtaccgacgatgatttatacgatacggtgattggctaccgtggcggcaactggatttatgagtgggccccggatctttgtgaaggaaccttacttctgtggtgtgacataattggacaaactacctacagagatttaaagctctaaggtaaatataaaatttttaacccggatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccaaaaaagaagagaaaggtagaagaccccaaggactttccttcagaattgctaagttttttgagtcatgctgtgtttagtaatagaactcttgcttgctttgctatttacaccacaaaggaaaaagctgcactgctatacaagaaaattatggaaaaatattctgtaacctttataagtaggcataacagttataatcataacatactgttttttcttactccacacaggcatagagtgtctgctattaataactatgctcaaaaattgtgtacctttagctttttaatttgtaaaggggttaataaggaatatttgatgtatagtgccttgactagagatcataatcagccataccacatttgtagaggttttacttgctttaaaaaacctcccacacctccccctgaacctgaaacataaaatgaatgcaattgttgttgttgggctgcaggaattaattcgagctcgcccgaca

SEQ ID NO: 98 - DNA, 9626 bp, Artificial sequence
  transcomplementation plasmid  p8.9deltaP (p157)
ttgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagagtctataggcccacccccttggcttcttatgcgacggatcgatcccgtaataagcttcgaggtccgcggccggccgcgttgacgcgcacggcaagaggcgaggggcggcgactggtgagagatgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaataaagataggggggcaattaaaggaagctctattagatacaggagcagatgatacagtattagaagaaatgaatttgccaggaagatggaaaccaaaaatgatagggggaattggaggttttatcaaagtaagacagtatgatcagatactcatagaaatctgcggacataaagctataggtacagtattagtaggacctacacctgtcaacataattggaagaaatctgttgactcagattggctgcactttaaattttcccattagtcctattgagactgtaccagtaaaattaaagccaggaatggatggcccaaaagttaaacaatggtcgacatagcagaataggcgttactcgacagaggagagcaagaaatggagccagtagatcctagactagagccctggaagcatccaggaagtcagcctaaaactgcttgtaccaattgctattgtaaaaagtgttgctttcattgccaagtttgtttcatgacaaaagccttaggcatctcctatggcaggaagaagcggagacagcgacgaagagctcatcagaacagtcagactcatcaagcttctctatcaaagcagtaagtagtacatgtaatgcaacctataatagtagcaatagtagcattagtagtagcaataataatagcaatagttgtgtggtccatagtaatcatagaatataggaaaatggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatccttggcacttatctgggacgatctgcggagcctgtgcctcttcagctaccaccgcttgagagacttactcttgattgtaacgaggattgtggaacttctgggacgcagggggtgggaagccctcaaatattggtggaatctcctacaatattggagtcaggagctaaagaatagtgctgttagcttgctcaatgccacagccatagcagtagctgaggggacagatagggttatagaagtagtacaaggagcttgtagagctattcgccacatacctagaagaataagacagggcttggaaaggattttgctataagctcgaggccgccccggtgaccttcagaccttggcactggaggtggcccggcagaagcgcggcatcgtggatcagtgctgcaccagcatctgctctctctaccaactggagaactactgcaactaggcccaccactaccctgtccacccctctgcaatgaataaaacctttgaaagagcactacaagttgtgtgtacatgcgtgcatgtgcatatgtggtgcggggggaacatgagtggggctggctggagtggcgatgataagctgtcaaacatgagaattaattcttgaagacgaaagggcctcgtgatacgcctatttttataggttaatgtcatgataataatggtttcttagtctagaattaattccgtgtattctatagtgtcacctaaatcgtatgtgtatgatacataaggttatgtattaattgtagccgcgttctaacgacaatatgtacaagcctaattgtgtagcatctggcttactgaagcagaccctatcatctctctcgtaaactgccgtcagagtcggtttggttggacgaaccttctgagtttctggtaacgccgtcccgcacccggaaatggtcagcgaaccaatcagcagggtcatcgctagccagatcctctacgccggacgcatcgtggccggcatcaccggcgccacaggtgcggttgctggcgcctatatcgccgacatcaccgatggggaagatcgggctcgccacttcgggctcatgagcgcttgtttcggcgtgggtatggtggcaggccccgtggccgggggactgttgggcgccatctccttgcatgcaccattccttgcggcggcggtgctcaacggcctcaacctactactgggctgcttcctaatgcaggagtcgcataagggagagcgtcgaatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcacatgagcgaaaaatacatcgtcacctgggacatgttgcagatccatgcacgtaaactcgcaagccgactgatgccttctgaacaatggaaaggcattattgccgtaagccgtggcggtctgtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaatcttttcaacgcctggcactgccgggcgttgttctttttaacttcaggcgggttacaatagtttccagtaagtattctggaggctgcatccatgacacaggcaaacctgagcgaaaccctgttcaaaccccgctttaaacatcctgaaacctcgacgctagtccgccgctttaatcacggcgcacaaccgcctgtgcagtcggcccttgatggtaaaaccatccctcactggtatcgcatgattaaccgtctgatgtggatctggcgcggcattgacccacgcgaaatcctcgacgtccaggcacgtattgtgatgagcgatgccgaacgtaccgacgatgatttatacgatacggtgattggctaccgtggcggcaactggatttatgagtgggccccggatctttgtgaaggaaccttacttctgtggtgtgacataattggacaaactacctacagagatttaaagctctaaggtaaatataaaatttttaacccggatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccaaaaaagaagagaaaggtagaagaccccaaggactttccttcagaattgctaagttttttgagtcatgctgtgtttagtaatagaactcttgcttgctttgctatttacaccacaaaggaaaaagctgcactgctatacaagaaaattatggaaaaatattctgtaacctttataagtaggcataacagttataatcataacatactgttttttcttactccacacaggcatagagtgtctgctattaataactatgctcaaaaattgtgtacctttagctttttaatttgtaaaggggttaataaggaatatttgatgtatagtgccttgactagagatcataatcagccataccacatttgtagaggttttacttgctttaaaaaacctcccacacctccccctgaacctgaaacataaaatgaatgcaattgttgttgttgggctgcaggaattaattcgagctcgcccgaca

SEQ ID NO: 99 - DNA, 9438 bp, Artificial sequence
  transcomplementation plasmid p8.9deltaPP (p158)
ttgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagagtctataggcccacccccttggcttcttatgcgacggatcgatcccgtaataagcttcgaggtccgcggccggccgcgttgacgcgcacggcaagaggcgaggggcggcgactggtgagagatgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaataaagataggggggcaattaaaggaagctctattagatacaggagcagatgatacagtattagaagaaatgaatttgccaggaagatggaaaccaaaaatgatagggggaattggaggttttatcaaagtaagacagtatgatctcgacatagcagaataggcgttactcgacagaggagagcaagaaatggagccagtagatcctagactagagccctggaagcatccaggaagtcagcctaaaactgcttgtaccaattgctattgtaaaaagtgttgctttcattgccaagtttgtttcatgacaaaagccttaggcatctcctatggcaggaagaagcggagacagcgacgaagagctcatcagaacagtcagactcatcaagcttctctatcaaagcagtaagtagtacatgtaatgcaacctataatagtagcaatagtagcattagtagtagcaataataatagcaatagttgtgtggtccatagtaatcatagaatataggaaaatggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatccttggcacttatctgggacgatctgcggagcctgtgcctcttcagctaccaccgcttgagagacttactcttgattgtaacgaggattgtggaacttctgggacgcagggggtgggaagccctcaaatattggtggaatctcctacaatattggagtcaggagctaaagaatagtgctgttagcttgctcaatgccacagccatagcagtagctgaggggacagatagggttatagaagtagtacaaggagcttgtagagctattcgccacatacctagaagaataagacagggcttggaaaggattttgctataagctcgaggccgccccggtgaccttcagaccttggcactggaggtggcccggcagaagcgcggcatcgtggatcagtgctgcaccagcatctgctctctctaccaactggagaactactgcaactaggcccaccactaccctgtccacccctctgcaatgaataaaacctttgaaagagcactacaagttgtgtgtacatgcgtgcatgtgcatatgtggtgcggggggaacatgagtggggctggctggagtggcgatgataagctgtcaaacatgagaattaattcttgaagacgaaagggcctcgtgatacgcctatttttataggttaatgtcatgataataatggtttcttagtctagaattaattccgtgtattctatagtgtcacctaaatcgtatgtgtatgatacataaggttatgtattaattgtagccgcgttctaacgacaatatgtacaagcctaattgtgtagcatctggcttactgaagcagaccctatcatctctctcgtaaactgccgtcagagtcggtttggttggacgaaccttctgagtttctggtaacgccgtcccgcacccggaaatggtcagcgaaccaatcagcagggtcatcgctagccagatcctctacgccggacgcatcgtggccggcatcaccggcgccacaggtgcggttgctggcgcctatatcgccgacatcaccgatggggaagatcgggctcgccacttcgggctcatgagcgcttgtttcggcgtgggtatggtggcaggccccgtggccgggggactgttgggcgccatctccttgcatgcaccattccttgcggcggcggtgctcaacggcctcaacctactactgggctgcttcctaatgcaggagtcgcataagggagagcgtcgaatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcacatgagcgaaaaatacatcgtcacctgggacatgttgcagatccatgcacgtaaactcgcaagccgactgatgccttctgaacaatggaaaggcattattgccgtaagccgtggcggtctgtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaatcttttcaacgcctggcactgccgggcgttgttctttttaacttcaggcgggttacaatagtttccagtaagtattctggaggctgcatccatgacacaggcaaacctgagcgaaaccctgttcaaaccccgctttaaacatcctgaaacctcgacgctagtccgccgctttaatcacggcgcacaaccgcctgtgcagtcggcccttgatggtaaaaccatccctcactggtatcgcatgattaaccgtctgatgtggatctggcgcggcattgacccacgcgaaatcctcgacgtccaggcacgtattgtgatgagcgatgccgaacgtaccgacgatgatttatacgatacggtgattggctaccgtggcggcaactggatttatgagtgggccccggatctttgtgaaggaaccttacttctgtggtgtgacataattggacaaactacctacagagatttaaagctctaaggtaaatataaaatttttaacccggatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccaaaaaagaagagaaaggtagaagaccccaaggactttccttcagaattgctaagttttttgagtcatgctgtgtttagtaatagaactcttgcttgctttgctatttacaccacaaaggaaaaagctgcactgctatacaagaaaattatggaaaaatattctgtaacctttataagtaggcataacagttataatcataacatactgttttttcttactccacacaggcatagagtgtctgctattaataactatgctcaaaaattgtgtacctttagctttttaatttgtaaaggggttaataaggaatatttgatgtatagtgccttgactagagatcataatcagccataccacatttgtagaggttttacttgctttaaaaaacctcccacacctccccctgaacctgaaacataaaatgaatgcaattgttgttgttgggctgcaggaattaattcgagctcgcccgaca

SEQ ID NO: 100 - DNA, 11070 bp, Artificial sequence
  vector plasmid pTrip?PBS CMV NEO ( pt134)
agggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcacatgagcgaaaaatacatcgtcacctgggacatgttgcagatccatgcacgtaaactcgcaagccgactgatgccttctgaacaatggaaaggcattattgccgtaagccgtggcggtctgtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaatcttttcaacgcctggcactgccgggcgttgttctttttaacttcaggcgggttacaatagtttccagtaagtattctggaggctgcatccatgacacaggcaaacctgagcgaaaccctgttcaaaccccgctttaaacatcctgaaacctcgacgctagtccgccgctttaatcacggcgcacaaccgcctgtgcagtcggcccttgatggtaaaaccatccctcactggtatcgcatgattaaccgtctgatgtggatctggcgcggcattgacccacgcgaaatcctcgacgtccaggcacgtattgtgatgagcgatgccgaacgtaccgacgatgatttatacgatacggtgattggctaccgtggcggcaactggatttatgagtgggccccggatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccaaaaaagaagagaaaggtagaagaccccaaggactttccttcagaattgctaagttttttgagtcatgctgtgtttagtaatagaactcttgcttgctttgctatttacaccacaaaggaaaaagctgcactgctatacaagaaaattatggaaaaatattctgtaacctttataagtaggcataacagttataatcataacatactgttttttcttactccacacaggcatagagtgtctgctattaataactatgctcaaaaattgtgtacctttagctttttaatttgtaaaggggttaataaggaatatttgatgtatagtgccttgactagagatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatcaactggataactcaagctaaccaaaatcatcccaaacttcccaccccataccctattaccactgccaattacctagtggtttcatttactctaaacctgtgattcctctgaattattttcattttaaagaaattgtatttgttaaatatgtactacaaacttagtagttggaagggctaattcactcccaacgaagacaagatatccttgatctgtggatctaccacacacaaggctacttccctgattagcagaactacacaccagggccagggatcagatatccactgacctttggatggtgctacaagctagtaccagttgagccagagaagttagaagaagccaacaaaggagagaacaccagcttgttacaacctgtgagcctgcatgggatggatgacccggagagagaagtgttagagtggaggtttgacagccgcctagcatttcatcacggtggcccgagagctgcatccggagtacttcaagaactgctgatatcgagcttgctacaagggactttccgctgggggactttccagggaggcgtggcctgggcgggactggggagtggcgagccctcagatcctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgccgaattcacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccactttggctgatacgcggatctacgcgtattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagcttggtaccgagctcggatcgatagcttaagcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcggaattcagtggatccactagtctcgagctcaagcttcgaattcccgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcatcgggaattctgcagtcgacggtacctttaagaccaatgacttacaaggcagctgtagatcttagccactttttaaaagaaaaggggggactggaagggctaattcactcccaacgaagacaaaatcgtcgagagatgctgcatataagcagctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtagtagttcatgtcatcttattattcagtatttataacttgcaaagaaatgaatatcagagagtgagaggccttgacattataatagatttagcaggaattgaactaggagtggagcacacaggcaaagctgcagaagtacttggaagaagccaccagagatactcacgattctgcacatacctggctaatcccagatcctaaggattacattaagtttactaacatttatataatgatttatagtttaaagtataaacttatctaatttactattctgacagatattaattaatcctcaaatatcataagagatgattactattatccccatttaacacaagaggaaactgagagggaaagatgttgaagtaattttcccacaattacagcatccgttagttacgactctatgatcttctgacacaaattccatttactcctcaccctatgactcagtcgaatatatcaaagttatggacattatgctaagtaacaaattacccttttatatagtaaatactgagtagattgagagaagaaattgtttgcaaacctgaatagcttcaagaagaagagaagtgaggataagaataacagttgtcatttaacaagttttaacaagtaacttggttagaaagggattcaaatgcataaagcaagggataaatttttctggcaacaagactatacaatataaccttaaatatgacttcaaataattgttggaacttgataaaactaattaaatattattgaagattatcaatattataaatgtaatttacttttaaaaagggaacatagaaatgtgtatcattagagtagaaaacaatccttattatcacaatttgtcaaaacaagtttgttattaacacaagtagaatactgcattcaattaagttgactgcagattttgtgttttgttaaaattagaaagagataacaacaatttgaattattgaaagtaacatgtaaatagttctacatacgttcttttgacatcttgttcaatcattgatcgaagttctttatcttggaagaatttgttccaaagactctgaaataaggaaaacaatctattatatagtctcacacctttgttttacttttagtgatttcaatttaataatgtaaatggttaaaatttattcttctctgagatcatttcacattgcagatagaaaacctgagactggggtaatttttattaaaatctaatttaatctcagaaacacatctttattctaacatcaatttttccagtttgatattatcatataaagtcagccttcctcatctgcaggttccacaacaaaaatccaaccaactgtggatcaaaaatattgggaaaaaattaaaaatagcaatacaacaataaaaaaatacaaatcagaaaaacagcacagtataacaactttatttagcatttacaatctattaggtattataagtaatctagccagatcctctacgccggacgcatcgtggccggcatcaccggcgccacaggtgcggttgctggcgcctatatcgccgacatcaccgatggggaagatcgggctcgccacttcgggctcatgagcgcttgtttcggcgtgggtatggtggcaggccccgtggccgggggactgttgggcgccatctccttgcatgcaccattccttgcggcggcggtgctcaacggcctcaacctactactgggctgcttcctaatgcaggagtcgcataagggagagcgtcgaatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaa

SEQ ID NO: 101 - DNA, 12150 bp, Artificial sequence
  transcomplementation plasmid p8.9 D64V (p6)
ttgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagagtctataggcccacccccttggcttcttatgcgacggatcgatcccgtaataagcttcgaggtccgcggccggccgcgttgacgcgcacggcaagaggcgaggggcggcgactggtgagagatgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaataaagataggggggcaattaaaggaagctctattagatacaggagcagatgatacagtattagaagaaatgaatttgccaggaagatggaaaccaaaaatgatagggggaattggaggttttatcaaagtaagacagtatgatcagatactcatagaaatctgcggacataaagctataggtacagtattagtaggacctacacctgtcaacataattggaagaaatctgttgactcagattggctgcactttaaattttcccattagtcctattgagactgtaccagtaaaattaaagccaggaatggatggcccaaaagttaaacaatggccattgacagaagaaaaaataaaagcattagtagaaatttgtacagaaatggaaaaggaaggaaaaatttcaaaaattgggcctgaaaatccatacaatactccagtatttgccataaagaaaaaagacagtactaaatggagaaaattagtagatttcagagaacttaataagagaactcaagatttctgggaagttcaattaggaataccacatcctgcagggttaaaacagaaaaaatcagtaacagtactggatgtgggcgatgcatatttttcagttcccttagataaagacttcaggaagtatactgcatttaccatacctagtataaacaatgagacaccagggattagatatcagtacaatgtgcttccacagggatggaaaggatcaccagcaatattccagtgtagcatgacaaaaatcttagagccttttagaaaacaaaatccagacatagtcatctatcaatacatggatgatttgtatgtaggatctgacttagaaatagggcagcatagaacaaaaatagaggaactgagacaacatctgttgaggtggggatttaccacaccagacaaaaaacatcagaaagaacctccattcctttggatgggttatgaactccatcctgataaatggacagtacagcctatagtgctgccagaaaaggacagctggactgtcaatgacatacagaaattagtgggaaaattgaattgggcaagtcagatttatgcagggattaaagtaaggcaattatgtaaacttcttaggggaaccaaagcactaacagaagtagtaccactaacagaagaagcagagctagaactggcagaaaacagggagattctaaaagaaccggtacatggagtgtattatgacccatcaaaagacttaatagcagaaatacagaagcaggggcaaggccaatggacatatcaaatttatcaagagccatttaaaaatctgaaaacaggaaagtatgcaagaatgaagggtgcccacactaatgatgtgaaacaattaacagaggcagtacaaaaaatagccacagaaagcatagtaatatggggaaagactcctaaatttaaattacccatacaaaaggaaacatgggaagcatggtggacagagtattggcaagccacctggattcctgagtgggagtttgtcaatacccctcccttagtgaagttatggtaccagttagagaaagaacccataataggagcagaaactttctatgtagatggggcagccaatagggaaactaaattaggaaaagcaggatatgtaactgacagaggaagacaaaaagttgtccccctaacggacacaacaaatcagaagactgagttacaagcaattcatctagctttgcaggattcgggattagaagtaaacatagtgacagactcacaatatgcattgggaatcattcaagcacaaccagataagagtgaatcagagttagtcagtcaaataatagagcagttaataaaaaaggaaaaagtctacctggcatgggtaccagcacacaaaggaattggaggaaatgaacaagtagataaattggtcagtgctggaatcaggaaagtactatttttagatggaatagataaggcccaagaagaacatgagaaatatcacagtaattggagagcaatggctagtgattttaacctaccacctgtagtagcaaaagaaatagtagccagctgtgataaatgtcagctaaaaggggaagccatgcatggacaagtagactgtagcccaggaatatggcagctagtttgtacacatttagaaggaaaagttatcttggtagcagttcatgtagccagtggatatatagaagcagaagtaattccagcagagacagggcaagaaacagcatacttcctcttaaaattagcaggaagatggccagtaaaaacagtacatacagacaatggcagcaatttcaccagtactacagttaaggccgcctgttggtgggcggggatcaagcaggaatttggcattccctacaatccccaaagtcaaggagtaatagaatctatgaataaagaattaaagaaaattataggacaggtaagagatcaggctgaacatcttaagacagcagtacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggaaaggaccagcaaagctcctctggaaaggtgaaggggcagtagtaatacaagataatagtgacataaaagtagtgccaagaagaaaagcaaagatcatcagggattatggaaaacagatggcaggtgatgattgtgtggcaagtagacaggatgaggattaacacatggaattctgcaacaactgctgtttatccatttcagaattgggtgtcgacatagcagaataggcgttactcgacagaggagagcaagaaatggagccagtagatcctagactagagccctggaagcatccaggaagtcagcctaaaactgcttgtaccaattgctattgtaaaaagtgttgctttcattgccaagtttgtttcatgacaaaagccttaggcatctcctatggcaggaagaagcggagacagcgacgaagagctcatcagaacagtcagactcatcaagcttctctatcaaagcagtaagtagtacatgtaatgcaacctataatagtagcaatagtagcattagtagtagcaataataatagcaatagttgtgtggtccatagtaatcatagaatataggaaaatggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatccttggcacttatctgggacgatctgcggagcctgtgcctcttcagctaccaccgcttgagagacttactcttgattgtaacgaggattgtggaacttctgggacgcagggggtgggaagccctcaaatattggtggaatctcctacaatattggagtcaggagctaaagaatagtgctgttagcttgctcaatgccacagccatagcagtagctgaggggacagatagggttatagaagtagtacaaggagcttgtagagctattcgccacatacctagaagaataagacagggcttggaaaggattttgctataagctcgaggccgccccggtgaccttcagaccttggcactggaggtggcccggcagaagcgcggcatcgtggatcagtgctgcaccagcatctgctctctctaccaactggagaactactgcaactaggcccaccactaccctgtccacccctctgcaatgaataaaacctttgaaagagcactacaagttgtgtgtacatgcgtgcatgtgcatatgtggtgcggggggaacatgagtggggctggctggagtggcgatgataagctgtcaaacatgagaattaattcttgaagacgaaagggcctcgtgatacgcctatttttataggttaatgtcatgataataatggtttcttagtctagaattaattccgtgtattctatagtgtcacctaaatcgtatgtgtatgatacataaggttatgtattaattgtagccgcgttctaacgacaatatgtacaagcctaattgtgtagcatctggcttactgaagcagaccctatcatctctctcgtaaactgccgtcagagtcggtttggttggacgaaccttctgagtttctggtaacgccgtcccgcacccggaaatggtcagcgaaccaatcagcagggtcatcgctagccagatcctctacgccggacgcatcgtggccggcatcaccggcgccacaggtgcggttgctggcgcctatatcgccgacatcaccgatggggaagatcgggctcgccacttcgggctcatgagcgcttgtttcggcgtgggtatggtggcaggccccgtggccgggggactgttgggcgccatctccttgcatgcaccattccttgcggcggcggtgctcaacggcctcaacctactactgggctgcttcctaatgcaggagtcgcataagggagagcgtcgaatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcacatgagcgaaaaatacatcgtcacctgggacatgttgcagatccatgcacgtaaactcgcaagccgactgatgccttctgaacaatggaaaggcattattgccgtaagccgtggcggtctgtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaatcttttcaacgcctggcactgccgggcgttgttctttttaacttcaggcgggttacaatagtttccagtaagtattctggaggctgcatccatgacacaggcaaacctgagcgaaaccctgttcaaaccccgctttaaacatcctgaaacctcgacgctagtccgccgctttaatcacggcgcacaaccgcctgtgcagtcggcccttgatggtaaaaccatccctcactggtatcgcatgattaaccgtctgatgtggatctggcgcggcattgacccacgcgaaatcctcgacgtccaggcacgtattgtgatgagcgatgccgaacgtaccgacgatgatttatacgatacggtgattggctaccgtggcggcaactggatttatgagtgggccccggatctttgtgaaggaaccttacttctgtggtgtgacataattggacaaactacctacagagatttaaagctctaaggtaaatataaaatttttaacccggatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccaaaaaagaagagaaaggtagaagaccccaaggactttccttcagaattgctaagttttttgagtcatgctgtgtttagtaatagaactcttgcttgctttgctatttacaccacaaaggaaaaagctgcactgctatacaagaaaattatggaaaaatattctgtaacctttataagtaggcataacagttataatcataacatactgttttttcttactccacacaggcatagagtgtctgctattaataactatgctcaaaaattgtgtacctttagctttttaatttgtaaaggggttaataaggaatatttgatgtatagtgccttgactagagatcataatcagccataccacatttgtagaggttttacttgctttaaaaaacctcccacacctccccctgaacctgaaacataaaatgaatgcaattgttgttgttgggctgcaggaattaattcgagctcgcccgaca

The invention claimed is:

1. A recombinant HIV-1 vector which cannot on its own achieve complete reverse transcription wherein the vector is a recombinant ribonucleic vector genome comprising (i) an intact 5' LTR retroviral sequence and a 3' LTR retroviral sequence flanking: an intact primer binding site (PBS) sequence, a retroviral psi encapsidation sequence and at least one transgene, and (ii) a coding sequence for a reverse transcriptase which is non-functional for completing reverse transcription, wherein the non-functional reverse transcriptase coding sequence contains a mutation affecting the DNA polymerase domain at position 110 of SEQ ID NO: 1 and/or a mutation affecting the RNAseH domain at position 478 of SEQ ID NO: 1, and wherein formation of DNA from the vector is prevented due to the presence of the non-functional reverse transcriptase.

2. The vector according to claim 1, wherein the reverse transcriptase comprises a mutation affecting polymerase activity and a mutation affecting RNAseH activity.

3. The vector according to claim 1, wherein the reverse transcriptase contains a mutation at position 110 of SEQ ID NO: 1 and/or a mutation at position 478 of SEQ ID NO: 1, the mutation being a substitution of the amino acid D at position 110 of SEQ ID NO: 1 by a naturally occurring amino acid residue selected from A, C, E, F, G, H, 1, K, L, M, N, P, Q, R, S, T, V, W, and Y, and/or a substitution of the amino acid E at position 478 of SEQ ID NO: 1 by a naturally occurring amino acid residue selected from A, C, D, F, G, H, I, K, L, M, N, P, Q, R, S, T, V, W, and Y.

4. The vector according to claim 3, wherein the reverse transcriptase coding sequence contains a mutation affecting the DNA polymerase domain at positions 110 of SEQ ID NO: 1 and a mutation affecting the RNAseH domain at position 478 of SEQ ID NO: 1.

5. The vector according to claim 1, wherein the recombinant vector genome further comprises at least one post-transcriptional regulatory sequence selected from WPRE, APP 5'UTR, TAU 3'UTR, and a miRNA target sequence.

6. The vector according to claim 1, wherein the transgene is selected from a catalytic nucleic acid, an aptamer, a miRNA, a decoy RNA, or a nucleic acid encoding a biologically active peptide.

7. The vector according to claim 6, wherein said biologically active peptide is an enzyme, a transcription factor, a growth factor, a trophic factor, a hormone, a cytokine, an antibody, a receptor, a differentiation factor, a colony stimulation factor, a suicide protein, a cell-cycle modifying protein, an anti-proliferative protein, a nuclease, a recombinase, transposase, a neurotransmitter or a precursor thereof.

8. A method for producing an HIV-1 vector comprising expressing within a cell the following transcomplementation elements:
   i) a transcomplementation capsid cassette, optionally split into several cassettes, comprising sequences derived from an HIV-1 genome encoding a retroviral gag sequence, said transcomplementation capsid cassette lacking any functional psi encapsidation signal, wherein said transcomplementation capsid cassette comprises a retroviral pol sequence encoding a reverse transcriptase which is non-functional for complete reverse transcription wherein the non-functional reverse transcriptase coding sequence contains a mutation affecting the DNA polymerase domain at position 110 of SEQ ID NO: 1 and/or a mutation affecting the RNAseH domain at position 478 of SEQ ID NO: 1, and wherein said transcomplementation capsid cassette comprises an intact primer binding site (PBS) sequence, ii) a transcomplementation envelope cassette encoding for an envelope glycoprotein, and iii) a transcomplementation vector cassette encoding for an HIV-1 recombinant ribonucleic vector genome comprising an intact 5' LTR retroviral sequence and a 3' LTR retroviral sequence flanking a retroviral psi encapsidation sequence, at least one transgene and, optionally, at least one post-transcriptional regulatory sequence, and recovering the HIV-1 vectors produced from the expression of the elements encoded by each cassette.

9. A composition comprising a vector according to claim 1.

10. The composition according to claim 9, wherein the composition is a pharmaceutical composition.

11. The vector according to claim 3, wherein the mutation is at position 110.

12. The vector according to claim 3, wherein the mutation is at position 478.

13. The vector according to claim 4, wherein the mutations are a D110E and a E478Q substitution.

14. The method according to claim 8, wherein the non-functional reverse transcriptase coding sequence contains a mutation affecting the DNA polymerase domain at position 110 of SEQ ID NO: 1 and/or a mutation affecting the RNAseH domain at position 478 of SEQ ID NO: 1.

* * * * *